(12) United States Patent
Bloksberg et al.

(10) Patent No.: US 8,017,833 B2
(45) Date of Patent: Sep. 13, 2011

(54) WOOD AND CELL WALL GENE MICROARRAY

(75) Inventors: Leonard N. Bloksberg, Auckland (NZ); Michael J. Frost, Parnell (NZ); Richard Forster, Parnell (NZ); Colleen Higgins, Sandringham (NZ); William H. Rottmann, Summerville, SC (US); Kim Norris-Caneda, Summerville, SC (US)

(73) Assignee: Arborgen, LLC, Summerville, SC (US)

( * ) Notice: Subject to any disclaimer, the term of this patent is extended or adjusted under 35 U.S.C. 154(b) by 337 days.

(21) Appl. No.: 12/096,516

(22) PCT Filed: Dec. 6, 2006

(86) PCT No.: PCT/US2006/046369
§ 371 (c)(1),
(2), (4) Date: Oct. 14, 2008

(87) PCT Pub. No.: WO2007/067525
PCT Pub. Date: Jun. 14, 2007

(65) Prior Publication Data
US 2009/0038033 A1   Feb. 5, 2009

Related U.S. Application Data

(60) Provisional application No. 60/742,926, filed on Dec. 6, 2005.

(51) Int. Cl.
*C12N 15/113* (2010.01)
*C12N 15/82* (2006.01)
*C12N 15/63* (2006.01)
*A01H 5/04* (2006.01)
*C07H 21/04* (2006.01)

(52) U.S. Cl. ........ 800/286; 800/285; 800/284; 800/278; 800/298; 435/320.1; 435/468; 536/23.1; 536/23.6; 536/24.5

(58) Field of Classification Search ................... None
See application file for complete search history.

(56) References Cited

U.S. PATENT DOCUMENTS

2004/0163146 A1* 8/2004 Phillips et al. ................ 800/284
2004/0214272 A1 10/2004 La Rosa et al.
2005/0120408 A9 6/2005 Reuber et al.

FOREIGN PATENT DOCUMENTS

WO   WO 2005/001051 A2   1/2005

OTHER PUBLICATIONS

Pratt et al 2003 GenBank accession CF386502, alignment is included in body of office action.*
International Search Report for PCT International Application No. PCT/US2006/046369, dated May 6, 2008 (5 pgs.).

* cited by examiner

*Primary Examiner* — Brent T Page
(74) *Attorney, Agent, or Firm* — Foley & Lardner LLP

(57) ABSTRACT

The invention provides polynucleotide and polypeptide sequences isolated from *P. radiate* and *E. grandis* that are involved in wood and cell wall biosynthesis. Methods for using the sequences, along with constructs and transgenic plants, are provided also.

16 Claims, 56 Drawing Sheets

Figure 1: Amino Acid sequence of 231. The conserved calreticulin domain is underlined. The Calreticulin family signatures 1 and 2 are in italics and the Calreticulin family repeated motif signatures are in bold.

MVSMDRRWIPLLLALLCLMSPLNALVSASE<u>STFYESFDESFEGRWIVSQKEDYKGVWKYEK
SKGHEDYGLLVSEVAKKYAIVRELPETIDPKDGSLVLQYE*VRLQNGLECGGAYLKYL*RPQEA
GWKPAEFDNESPYS*IMFGPDKC*GATNKVHFIYKHKNPKSGEYVEHHLKYPPSIPSDKKTHVY
SAILTPDNQVRILIDGEEKKKANLLSADD**FEPALIPPKTIPDPEDKKPEDWDERAKIPDPDAEK
PEDWDEDAPMEIEDLEAVKPEGWLDDEPEEVDDPEATKPDDWDDEEDGEWEAPKVSNPK
C**DEAPGCGEWTRPMKSNPDYKGKWYAPMIDNPNYKGIWKPQQIPNPEYFELEKPDLEPIAAI
GIEIWTMQDGILFDNILITHDEKVAEEYRKNTWKAKFSNEKEEEDVDSPLPGELSGFQKKIFDV
LYKIANIPFLEAYKLKIIDLIEQGEKKPNLTIGILVAVLVVLLTTIYKLLFGGKKQPVQKVELKSQP
EQDASASENNKEDSDIAAENEKSDAAEKEKSGDENEIEGEDAAPRQRRVRRET</u>

Figure 2: Amino Acid sequence of 232. The conserved calreticulin domain is underlined,The Calreticulin family signatures 1 and 2 are in italics and the Calreticulin family repeated motif signatures are in bold.

MAGRRSLLYAVFLLLFATLVSAE<u>VFFEERFDDSWESRWVQSDWKKDESLAGDWVHTAGKW
NGDPNDKGIQTHTDYRFFAISAAYPEFSNKDKTLVLQFS*VKHEQKLDCGGGYVKLL*SGEIDQ
KNFSGETPYS*IMFGPDICG*YSTKKVHTILSYKGKNHPIKKDVPCETDQLTHVYTFILRPDATYSI
LIDNTDKQSGSLYKDWDLLPPKTIKD**PNAKKPEDWDDKEYIPDPEDKKPEGYDDIPKEIPDPD
ATKPEDWNDEEDGEWTAPTIANPEYKGPWKPKKIKNPNYKGKWKAPMIDNPDFKDDPELY
**VFPNLKYLGIELWQVKSGTLFDNILISDDPEYAKKLAEETWAKHKDAEKEAFDEAEKKKEEEE
KEKESDDEEDTDEKEEKSDDEDADELDDEHKEADKKEHELDSEHKEEDKKEHDEL</u>

Figure 3: Amino Acid sequence of 234. The conserved Glycoside hydrolase, family 17, domain is underlined.

MGRAGLRTSLLCILIFLSGLALSNAQSKISSS<u>TTGINYGQVADDLPSPELVVGLLQTNSINKVKL
YSVNETVLKAFANTGIELIVGMGNENVGNMTDPTKATEWVNENIRAYLPATKITGIAVGNEVY
TGTDTQLMANLVPAMKNIHSALVSIGADMNIKVTTPHSLAVLGNSFPPSAGSFASNVKSLMKP
LLDLLSQIGSPFFINAYPYFAYKGDPSQISLAYVLFEPNTGVIDPNNNVHYNNMLYAQIDAVYS
ALSALGYANIEVTVSETGWPSKGDANEAGATLQNAQTYNGNLLQLLAQNQGTPLRPKLVLQ
AYLFALFNEDMKPGPASERNYGLFKPDGTAVYNLGLSGTLSTGSPSTGSTSTGSFTTGTPPP
AAYPSTTDSSYSYYSSAKETYSVISFYNHLLLLGLSTFFVVPLFLP</u>

Figure 4: Amino Acid sequence of 235. The conserved glycosyl hydrolases domain of family 17 is underlined.

MGASVMGSGDLRMFCLLALVLLSGLVLSNSASSTSSSA<u>TGINYGQVADNLPSPEVVVGLLQT
RNINKVKIFSANETVLKAFANTGIELIVAIGNENVGNMTDPTKATEWVNENIQAYLPATKITCIA
VGNEVYTGTDTQLMENLVPAMKNIHSALVSIGADTDIKISTPHSLGVLGNSYPPSAGSFTSDL
TSLMKPLLDFLSQIDSPFFVNVYPFFAYKANPSQISLDYVLFRPNAGVVDPNNNISYNNMLYA
QVDAVYSALSALGYPNLEVTVSETGWPSMGDADEAGATLQNAQTYNGNLLQLLAQNQGTP
LRPKVVLQAYLFALFNEDMKTGPTSERNYGLYKPDGTAVYSLGS</u>TGTLSTGSTRTVATASYP
TAADGPSSSAKETYSVVSFYNHLQLLGLSTFFVFLLFRP

Figure 5: Amino Acid sequence of 236. The conserved family 17 glycoside hydrolase domain is underlined and the glycosyl hydrolases family 17 signature is in bold.

MVFGISCRMAMVFIVWALMAFLSVGLEDSKALAITGST<u>VGINYGQIADNLPPPAKVAELLKALK
VTKVKLYDWNPAILKAFANSDVELVVGIGNGFVAGLMDTQAALSWVTQNIQPYLSSTKVTGF
SVGNEVYTGDDAALKANLVPAMRSIHTALVSLGLDSAIKISTAHSLSVLTSSYPPSAGAFDPAI
MQLLREHLDFLAVTGAPFWINAYPFFAYKDNAGKISLDYALLKPNPGTDDPNTHLHYDNMLY
AMVDAVYSALGAMGYGNLEVRISETGWPSKGDADELGASIQNAATYNRNLLQRLLKNQGTP
MKPNSALQAYIFALFNEDLKNGPTSERNYGLFKPDESMVYNIGLEGGLTVEFSAYASSAQI</u>

Figure 6: Amino Acid sequence of 237. The conserved Glycoside hydrolase, family 17, domain is underlined.

MEIIVRVSAITILLPLFIHCIRCGESIGRSRTLVEHSPA<u>LGVNYGQMADNLPSPSGVAKLVQSTT
ISKLRIYGADPAILQAFANTGIGLLVGISNDQIPSLNQLAVAQNWVKSNIVPFVPATDIIGISVGN
EVLFSGDRVLISQLLPALQNLHTALVEVSLDQQIKVSTPHSMAILSASAPPSAGRFSGSFDMK
ALLDFLQKIGAPFMINPYPYFAYKSDPTDRTLAYALFEPNQGSYDTNTGLKYTNMFDAQLDAV
YSAMKYLGYTDIDIVVAETGWPSAGDPSETGASLQNAIAYNGNLIKHVTSMAGTPMMPNRSI
EIYIFGLFNEDLKPGPTSERNFGLFKTDMTMAYDVGLLRSQSASPSPAAPRTGGPVVAPPTA
KVWCIAKPGVDEKSLKQNLDYACGQGIDCKPIQQGGPCYLPNTMASHAAYAMNAYYQSAG
RNSLNCDFAQTGTVTSKDPSYGGCVYSTVNS</u>

Figure 7: Amino Acid sequence of 238. The conserved Glycoside hydrolase, family 17, domain is underlined.

MEMIVKATTITILLPVILCCIPCGESGSGGRSLAQRLPA<u>LGVDYGQTADNLPPPSAVAKLVQST
SISKLRLYGADPAILQAFANTGIGLVVGIGNDQIPSLNQLAVAQNWIKNNIVPFVPATDIIGISVG
NEVLFSGDGSLISQLLPALQNLHTALVEVSLDQQIKVSTPHSLAILSTSVPPSAGRFNESFDMK
SLLDFLQKIGAPLMINPYPYFAYKSNPTDQTLAYALFEPNPGFYDTNSGLTYTNMFDAQLDAV
YSAMKYLGYPGVDIVVAETGWPAVGDPTETGVSLQNAIAYNGNLIKHVTSMTGTPLRPNRYI
QTYIFALFNEDLKPGPTSERNYGLFKVDMTMAYDVGLLQSPSAAPSPPAPRTGGPVTTPPTG
KVWCIAKPGAEEQTLEANLNYVCGQGIDCRPIQPGGPCYSPNTVAGHAAYAMNAYYQTAGR
NNWNCDFAQTGTLTSTDPSYGACVYPTV</u>

Figure 8: Amino Acid sequence of 239. The conserved Glycoside hydrolase, family 17, domain is underlined.

MAASKDQMKILLLGCVAIYCYSIIAGGDK<u>IGVNNGMVGDNLPPADQVVALMKQNNIGKYRIFQ
GSPEVLPAFANSGIDVIVGIETNRLQEMSSSQDAADSWVKTNIVPFYPATNIKYIAVGNEVVKV
KENVSYLLPAMKNIQTALQNANPQNKIKVSTTHASESVIGNALIPPSKGVFLDDVKDTMSSVL
KFLSDNEAPFMANVYPFFSYVNENWRNISLEYALFKSTSPVMQDGDHSYINLFDAIVDTIISA
MENLGYQDFPLIITESGWPSAGLNVATVDNAQAYNNNLIKHVLSNAGTPKRPGRSIETYIFAIF
NENQKPGAETERHFGLFNPDKTPVYSVNFSPY</u>

Figure 9: Amino Acid sequence of 240. The conserved Glycoside hydrolase, family 17, domain is underlined.

MEAKTRPTAELDLRRGMGFRWAFILLLSVASIQSTEGFSVTGT<u>VGINYGQIANNLPPPSQVVE
LLQASNLTNVRIYDANPQILNALRNTSVEIVVSLGNEYVATMSARPDKARQWVKKNVAAYIPA
GTNITGVLVGNEVYAGNDTVLKNNLMGALKNIHSALVSLGLDNTVKVSTAHSFDVFVSSFPPS
SCAFSDKSVTYMKQLLDFLSATHAPFLVNVYPYFAYKGDPSNVPLDYALFRPSNGVVDSKTN
LHYDNLFYAQIDAAYSALAALGYGKVEVRVSETGWPSKGDDDELGATPENAKTYNGNLLER
LHKKEGTPLKPNVSVQAFIFALFNENLKSGPTSERNYGLFKPDGTETYDLGLKGLKRIVSSLP
PPPTVATGNSSNSTPTTAITSLTAPSPSVSTGDGTNSSSDSSSAKGMHSLVFISFYLQILALSS
FISVLILEH</u>

Figure 10: Amino Acid sequence of 241. The conserved Glycoside hydrolase, family 17, domain is underlined.

MEAKTRPTAELDLRRGMGFRWAFILLLSVASIQSTEGFSVTGT<u>VGINYGQIANNLPPPSQVVE
LLQASNLTNVRIYDANPQILNALRNTSVEIVVSLGNEYVATMSARPDKARQWVKKNVAAYIPA
GTNITGVLVGNEVYAGNDTVLKNNLMGALKNIHSALVSLGLDNTVKVSTAHSFDVFVSSFPPS
SCAFSDKSVTYMKQLLDFLSATHAPFLVNVYPYFAYKGDPSNVPLDYALFRPSNGVVDSKTN
LHYDNLFYAQIDAAYSALAALGYGKVEVRVSETGWPSKGDDDELGATPENAKTYNGNLLER
LHKKEGTPLKPNVSVQAFIFALFNENLKSGPTSERNYGLFKPDGTETYDLGLKGLKRIVSSLP
PPPTVATGNSSNSTPTTAITSLTAPSPSVSTGDGTNSSSDSSSAKVVL</u>

Figure 11: Amino Acid sequence of 242. The conserved Glycoside hydrolase, family 17, domain is underlined.

MPTPKPKIFWLLLLILGLTIHAYAEDYT<u>IGVAYGQYGDNLPSVQESIDLIQRLKVGRVKIYSTNP
VILKALSNTGIKVSVMVRNEDIAGLSASQSVADKWVNDNIVPFYPATEINIILVGNEILTDYSNK
QTWYQLVPAMQSIWQALVNYNLDHINVGTPLAMDMLGSSVPISAFPPSAGTFRDDIAETVMK
PMLEFLHRTNSYFFMDVYSYFPYLFDPEDISLEYANFGENDKKYTDPNGLVYTNMLDQQLDA
VVAAMSKMGYDDIKLAIAETGWPNAGDISQLGANINYAALYNRRVIRRMVADPPLGTPRRPN
QFIPTYIFLLYDEDKKSGPGTERHWGFVYPNGTLMYEIDL</u>TGKLQDSDYGPLPPPPPPYKGK
LWCVADPTADVYALPSAIDSACSQGDSTCDAIQPGEPCYEPNTVIDHASYAFNSNWQRSKN
FYSGCDFNKTAKLVTEDPSHGNCIYEFVDCVQKSVLC

Figure 12: Amino Acid sequence of 243. The conserved Glycoside hydrolase, family 17, domain is underlined.

MGEKLGSRGLLILLAFVLCISFTAEA<u>IGVNYGRMGDDLPPPSEVAKFLQTTIIDKVKLFDADPG
VLQAFANTNIGVVVAVANDQIAALNKLPAAQDWVKKNVAPFVPATNIIAISVGNEILSTGDKVLI
SQLVPAMQNLHTALVGASLDKQIKVSTPHSLGILSASEPPSIGRFRRGYDRVILKPLLNFLRTT
GAPFMINPYPYFGYTDKTLNYALFKPNQGVFDNNTGITYTNMFQAQLDAVYSAMKLLGFSDV
DIVVAETGWPSVGDPDQTAVNVENALSYNGNLIKLVNTNAGTPLMPNKTFDTYIFSLFNEDLK
PGPTAERNFGLFKPDMTMVYDVGLMKSESATPAPISTAPVTPATPAPISTAPVTPTTPAPIST
APVTPTTPAPVTGTDKSWCVAKPDADPNVLQDNIDYACGQGVDCSAIQAGGQCFTPNTVVA
HATYAMNSYYQLTGRHSYDCDFAQTGFLTQEDPSYGTCVYPTI</u>

Figure 13: Amino Acid sequence of 244. The conserved Glycoside hydrolase, family 17, domain is underlined.

MDGMHGSKVCRYSRMQRTVPMLCTLLVAALGHLVILSAAANSGVFPPFYTRALGINYGRVA
DNLPSPSSAVALIKNLQAGYVKIYDADPQVLSALSNTALQVTITVRNQDISNISSSPTVAEQWV
QANVLPHYPATLITAIMVGNEVLSDYQNQATWLLLLPAMANIHASLLNHGLADSIKVTTSLAM
DVLSSSYPPSEGTFRSDVASPVLQPLLDFANRTGSFLFLDIYPFFAWSANPANVSLDYATLSL
DRNTAEFQDAGLSYSNMLDAQLDAVLAAMDRLGFPSVNVVIGETGWPTKGDDNQPGTNVP
NATLYNQQLVQKALADPPRGTPRRPGAFIPTYIFSLFNEDQKPGPTTERNWGLFYPNGTPVY
PIVLSNDAPVLSHISVPSQNNAPFPSTPPGPVAAVQWCVVSPVAVAQVDETSLQAALDYACG
AGADCSLIEPGEPCYLPNTLVSHASYAFNSYWQKNKAAGATCDFNGSAVLSSSDPSVGDCV
FDHM

Figure 14: Amino Acid sequence of 245. The conserved Glycoside hydrolase, family 17, domain is underlined.

MGLMWVMFVCSLVLHIAGANEPEASPQPNPGIGVNYGTEGNNLPSPKQVAKMLGKTIVNRV
KIYNSEPSILQAFANTGIAVVVGLENEKVQRISESPTAGQAWVAQRIAPYYPSTLIILITVGNEV
LTNSDGSLDSALVPAIQNIHSGLVALGLDDKIKVSTPHSMAILSSSFPPSASTFATSLLPIMKPL
LKFLDDTGAPFMVNAYPYFAYRDNPKEVSLDYVLFGQSPGVSDPKGFTYNNMLDAQIDSIYS
AMAALGHNDTIPVTVSETGWPSKGDPDDIGVNPDNARNYNTRVIKHVTSNAGTPMRPNRVIE
TFIFALFNENHKPGPTTERNFGLLNPDGSKVYDVDLSCGWCASPPPPYSPPASPPPSPISLF
SGPPKGSRGGLGFAVYCIAKPSSDPSVLQESLDFSCGLGGADCASIRQGGPCYNPNTVHAH
ASYAMNSYYQIHGRNYWNCDFKSTGLVTFTDPSYGSCHYPQE

Figure 15: Amino Acid sequence of 246. The conserved Glycoside hydrolase, family 17, domain is underlined.

MAMEGPRSGLALIISNFIFFLLSGSARTGTASNATIGINYGQIADNLPSPQRVAGLLRSINIIKKV
KLYDANREVLEAFANTGIEFVVGLSNEYVGNMTDQAAAVDWVKENVQGYLPGTNITCIAVGN
EVFTSNNTLWMSNLVPAMQNIHSALVSLGLQDSVNVTTAHSSFVLATSYPPSAGAFKPELTA
FLRPLLDFLSQTTSPFLINAYPYFAYKDNADQIPLDYVLFQPNAGTVDPGTNLHYSNMLHAQI
DAVYSALSALGYSAMEIKVSETGWPSKGDSDEVGATPENARIYNGNLLQLLAQNQGTPMRP
SVRLESYVFALFNEDQKPGKTSERNYGLFKSDGSPAYDVGLHGSLSGASANPILYSKVVVSS
LCSLFLLFFLGL

Figure 16: Amino Acid sequence of 248. The conserved Glycoside hydrolase, family 17, domain is underlined.

MGVSLMGRGSLGMSCLWALVLLSGLALSNALSSTSATTTGINYGQVADDLPPPELVVGLLQT
SNIGRIKLYTVNATVLKAFANTGIELIVGVANDIIGNLTDSNSATEWVNENIQTYLPATKIIGIAVG
NEVYTGTDTQLMANLVPAMQNIHSALVSIGADTDIIISTPHSLGVLATSYPPSAGSFQPGLESL
LEQLLALLSQIGSPFFINAYPYFPYEAQPSQIPLDYVLLEPNASAVVDQNNNVVYKNMLYAQV
DAVYSALSALGYPNIEVIVTETGWPSNGDADEAGATLQNAQTYNGNLLQLLAQNKGTPLRPN
VVLQAYLFALFNEDMKPGPTSERNYGLFGPNGVEVYNVGLTGSLSIGNKKAVSVGSPTGSA
DTPYYNTASAKETCTDISFYNHLQVLALSSFLVLLLFLP

Figure 17: Amino Acid sequence of 249. The conserved glycosyl hydrolases, family 17, domain is underlined and the glycosyl hydrolases family 17 signature is in bold.

MGMLYWTMDKLLLLFWVLLLMLAQSPGLTRGST<u>VGVCYGREGDDLPTPDKVAQLVKSIALK
NIIIYDSNVQVLQAFAHTGIELIIGIPNSDLLGFSQYQSTADTWVTNNLLPYYPATMIKYIAVGTE
VTESTINVTSLVVPAMRNLQTALKKAGLDQKIKVSSTHALSILSRSFPPSAGAFDSKYAFFLSP
LLQFLAQTQSPFMINVYPYYAYRDSPRKVSLDYALFRPNDGVIDQNTGLVYTNMFDAQLDAL
FFALEALNFRSLRVMVTETGWPSKGGSKEPAATPDNAATYNGNLVRHVINNTGTPSRPGQE
IDTYVFALFNENRKPGLESERNWGLFYPDETKVYNVDISGTGLPYVATGGNLTSVDGTSWCV
ASPSAKESDLQKALDWACGSGNVDCSPIQPGQPCYEPDNLASHASYAFNSYYQKNGASSV
ACNFGGTGNITTINPSYESCVYTTSRNGLANTTSTLSSSGVDSIASFSWLIGWVTTLFLVHLLT</u>
ILKWL

Figure 18: Amino Acid sequence of 250. The conserved Glycoside hydrolase, family 17, domain is underlined.

MTFLFWVLVIFVLVGWVQG<u>LGVNWGTQASHPLPPDAVVEMLKDNGITKVKLFDADEHTMKA
LANSGIQVMVGIPNDQLQVMATSTKDAANWVETNVTEFNLDGGVDIGYVAVGNEPFLKAYN
GTFIQYTFPALQNIQNALNKAGLKNIKATVPLNADVYQGDTPSEGQFRPDINDLMIQICQFLAS
NGAPFTVNIYPFLSLYTNENFPVDFAFFDGTGQPVIDGNIQYTNVFDAALDTLFWALKRAGFP
DLPVLVGEVGWPTDGDKHANINFAQRFNQGLLKHIMNGRGTPLRPQNIETYLFSLVDEDAKS
IAPGNFERHWGIFQYDGTPKYALDLSGQTQNTALVSAKGVKYLPRRWCVFNPSASPSVLTQ
LPDSITYACTHGDCTSLGFSSCNSLDYQGNASYAFNSYYQVNNQQNGACGFSSLAIVTES
DPSQGTCKFEIQIAVSAASNTMNS</u>YLYSLISVAGAVAVVLLSVL

Figure 19: Amino Acid sequence of 251. The conserved glycosyl hydrolases family 17 domain is underlined.

MNDKMPLYLLYVFYCLAIFVIPTEAGREWNS<u>IGINYVRAGKNLLSPAEAVSLMKALKIGRVKLY
DSDPEVLTALANSGLSVVIAVKNEEIPTVASSILNADEWVKQSVLAHYPATRINAITVGNEILTD
YNNQDRWSKLVPAMQNIHSSLVRWNLNKRIKVTTTVAMDALNSSSAPSLARIRDDIAESVMK
PLLRFMSNSKSFYFVNAYPYFAWAANANKVPVDYAIFGAAKEAVQDGGLKYTDMLSAQLDA
NLAAMEKLGYPHVKIAISETGWPASGGPGANVDLAATYNRRVVVRMLANPPLGTPRRPRTF
VPTYLFALFDADNNKHGTTRNWGMLYPNGSQVYPVDMTDKLTDLEFESLKSIRPFPARPTPI
RSSISRSSPLTGSYPSPVPSYYSGPPTLVNPPAASPSTDNIPFSSPIPSVHPNPHPTINVPPYS
PSPISTSPPTFSPPIVNYPPHCMPYPPTTPITTPPFAPYPPSNPTVPYTPNPPSTTPYSPYPPS
TPSTPSSQSLWCVAKPTVPNSVLQQAMNYACGAGADCKSIQPNGLCFSPDTMVAHAS</u>FAF
NSYWQKNKGIGGTCDFGGTAMLITMDPSYEGCHFGLI

Figure 20: Amino Acid sequence of 252. The conserved Glycoside hydrolase, family 17, domain is underlined.

MAASNEQMKRIVIGLIAVFCCAIVTDGDK<u>IGVNYGMQGDNLPPADQVVTLLNGHNIGKMKLFN
PDGGALNAFANSGIDVIVGVSNNDLQAISSSQDSANGWVNDNIVRYSSTSIKYIAVGNEVLPS
TQYVSYLVPAMNNIQTAIQNANLQNIKVSTPHAFNVIGVSSPPSHGAFSDDVKDTMSSILKFLS
DNGAPFMANVYPYFSYAGDTTDIHLDYALFQPTATPVTDGDHSYKNLFDAMVDSIFSAMEAL
GYSNVPLIVTESGWPSAGADAATTENAQAYNNNLIQHVLSNSGTPKRPGTNIETYIFALFNED
QKTGDEIERHFGLFNPDQSPAYSVNFSP</u>

Figure 21: Amino Acid sequence of 253. The conserved Glycoside hydrolase, family 17, domain is underlined.

MAASNEQMKRILIGFIAIFCCSIVTDGDK<u>IGVNYGMLGDNLPPADQVVTLLNGNNIGKVKLFDP
DGGALNAFANSGIDVIVGVSNSDLQAISSSQDSANGWVNDNIVPYSSTSIKYIAVGNEVLPST
QYVSYLVPAMNNIQTAIQNANLQNIKVSTPHAFSVIGNSYPPSKGAFSDDVKDTISSILKFLSD
NGAPFMVNVYPYFSYVGDSNDIHLDYALFQPTATAVTDQDHSYSNLFDAMVDSVFSAMEAL
GYSNIPLIVTESGWPSAGADAATTENAQAYNNNLIQHVLSNAGTPKRPGTNIETYIFALFNED
QKTGDEIERHFGLFNPDQSPAYSVNF</u>YPN

Figure 22: Amino Acid sequence of 254. The conserved Glycoside hydrolase, family 17, domain is underlined.

MAAMKITLIGCIAILCSILADAAQ<u>IGVNNGMVGNNLPHADEVVTLLKEHNIGKYRIFQGSPGVLK
AFENSGIEVIVGIETNRLQQISSSQEAANGWVKDNIVPFYPATNIKYIAVGNEVFKSNENVQYL
VPAMKNIQTALNMANLQNKIKVSTTHASESVIGNSYPPSKGAFTDEVKDTMRSVLQFLSDNE
APFMANVYPFFSYVNNWKNIKLDYALFQSKSPVVESYTNLFDAIVDTIISAMENLGYDNIPLIVT
ESGWPSGGNINVATIEYARTYNNNLIRHVLSNAGTPKRPGRSIETYIFALFNEDKPSQDDTER
HYGLFYPNKSPVYAVNFSP</u>

Figure 23: Amino Acid sequence of 255. The conserved Glycoside hydrolase, family 17, domain is underlined.

MAASKEQAKIILVGFIAIFWGSILTDGDK<u>IGINYGIQGSDLPPADEAVSLMKKNNIGKARIFKAQ
KDALKALADSGIDVIVGVATEDLQGISSSQHSADAWVNDNIVAFYPATNIKYIAVGNLILCSPQ
YISYLLPAMTNIQIALQNANLQNSIKVSTTHNMSVIAGIDFPVSNGANGDNVKDTTRSLLNFLIA
HNSAPSQGTFSDDVKDSMRSILEFLSYHGSPYMANVYPYFIFTGGSSGSMSLDYALFKPTSP
LVDGVRRYTNLFDAMVDTIISAMENLGYPDVPLIVTESGWPSFGEDVATVENAQTYNNNLIKH
VLSNAGTPKRPGTSIETYIFALFRENLKSGPTTEHDFGLFNRDQTPAYTVNFSPLL</u>

Figure 24: Amino Acid sequence of 256. The conserved Glycoside hydrolase, family 17, domain is underlined.

MAASTEQAKIILVGFIAIFWGSILTDGDK<u>IGVNYGIQGSNLPPADEAVSLMKKNNIGKCRILKAN
RDELKALANSGIDVIVGVGTEELQAISSSQDSADAWVNDNIVAFYPATNIKYIAVGNLILCSPQ
YISYLLPAMTNIQTALQNANLQNSIKVSTTHNMSVIAGIDFPVSNGANGDNVKGTTRSLLNFLI
AHNSAHSQGTFSDDVKDSMRSILEFLSYHGSPYMANVYPYFIFTGSSGSISLDYALFKPTSPL
VDGVRRYTNLFDAMVDTIISAMENLGYPDVPLIVTESGWPSFGEDVATVENAQTYNNNLIKH
VLSNEGTPKRPGTSIETYIFALFRENLKSGPTTEQDFGLFNRDQTPAYTLNFSP</u>

Figure 25: Amino Acid sequence of 257. The conserved Glycoside hydrolase, family 17, domain is underlined.

MERQWFAILIICALGSMVCAVEGL<u>GVNWGTMALHQLPPDIVVQMLKDNGIKKVKLFDADSNT
LQALANTDIEVMVAIPNNMLQRFSDSYKAAEKWVDKNVTRYNFSGGVNIKYVAVGNEPFLSA
YNGSYLNNTFPALQNIHKALVKAGLADQIKVTVPLNADVYNSPTDNAVPSAGDFRADIHDLMS
EIVTFLNDNGSPFTVNIYPFLSLYADENFPTDFAYFDGDSQPLVDGNIQYTNVFDANLDTLVW
SLKKAGVPNMTIIVGEVGWPTGDKHATAAAAQRFNQGLLKHITSNQGTPMRPGNIEAYLFG
LLDEDAKSVAPGNFERHWGIFGYDGQPKYELDL</u>SGPLQNGGLVPAKNVQYLPPKWCVFKT
NATDQSKILDSIKYACTYSDCTAMGYGSSCNNLDLYGNASYAFNMYFQVMNQYEINCDFTGL
AMITEQNASQGTCKFPIGIAYGAAERSIKIHSILAAVLLGVVTFILSFL

Figure 26: Amino Acid sequence of 259. The conserved family 17 glycoside hydrolase domain is underlined and the glycosyl hydrolases family 17 signature is in bold.

MEIIVRVSAITILLPLFIHCIRCGESIGRSRTLVEHSPALGVNYGQMADNLPSPSGVAKLVQSTT
ISKLRIYGADPAILQAFANTGIGLLVGISNDQIPSLNQLAVAQNWVKSNIVPFVPATDIIGISVGN
EVLFSGDRVLISQLLPALQNLHTALVEVSLDQQIKVSTPHSMAILSASAPPSAGRFSGSFDMK
ALVDFLQKTGAPFMINPYPYFAYKSDPTDRTLAYALFEPNQGSYDTNTGLKYTNMFDAQLDA
VYSAMKYLGYTDIDIVVAETGWPSAGDPSETGASLQNAIAYNGNLIKHVTSMAGTPMMPNRS
IEIYIFGLFNEDLKPGPTSERNFGLFKTDMTMAYDVGLLRSQSASPSPAAPRTGGPVVAPPTA
KVWCIAKPGVDEKSLKQNLDYACGQGIDCKPIQQGGPCYLPNTMASHAAYAMNAYYQSAG
RNSLNCDFAQTGTVTSKDPSYGGCVYSTVNS

Figure 27: Amino Acid sequence of 260. The conserved family 10 glycoside hydrolase domain is underlined.

MHFTTAALVSALAATPVVYGQLDSKFKAKGKKYFGTCSDSGLLSVSQNANIIKSDFGALTPEN
SAKWDSIEPSRNGFNFGGFDTLVNFAQSNGKLVRGHTFVWHSQLPSWVSSIGDAATLTTVI
QNHITTIATRYKGKIYGWDVVNEIFNEDGSLRSSIFSQRLGENFVSIAFKAARAADSNAKLYIN
DYNLDSVNSKVNGLVALVNRQKSAGTPIDGIGSQTHLSAGGSGGVQAAIQKLATTGCDVAIT
ELDIASAPTSDYVAVVKACLNTPKCVGITVWGISDKDSWRTGANPLLFDSNYQKKAAYNSIIS
ALA

Figure 28: Amino Acid sequence of 261. The conserved N and C terminal domains of family 3 ofThe Glycoside hydrolases are underlined.

MENFVLVLFCIGIGVFFNGGSLVQSAGSFPCDPSTGLSSFPFCNTSLPIGDRVKDLVGRLTLQ
EKVEQLVDQTTAIPRLGIPVYLWWSEALHGVSNVGHGTKFGGSIPGATSFPQVILTAASFNTS
LWKEIGQVVSTEARAMYNAGQAGLTFWSPNVNIFRDPRWGRGQETPGEDPLVASLYATNY
VQGLQETNGADTNRLKVAACCKHYTAYDVDNWNGFQRYTFDAIVSQQDLEDTYDVPFKSC
VLNGNVASVMCSYNKVNGVPTCADKNLLAGTIRGNWSLNGYIVSDCDSVSVYYNQQHYGAT
PEDAAADAINAGLDLDCGSFLGQHTEAAVNESKVTESAVDQALINTFTVLMRLGRFDGDPAQ
QPYGNLGPNDVCTNENQQLALEAAREGIVLLKNDGSLPLAAKNISSLAVIGPNANVTKTMIGN
YAGIPCKYTTPFQGLSAYTQTLYAPGCANVACISNDSLIAEAVQTASSADATVLIVGGDLSLEA
ESLDRTSLLLPGQQQQLVTQVADASKGPVILVIMSGGPFDISFAKNSDKISGILWVGYPGQAG
GAAIADVIFGEYNPGGRLPVTWYPEEFSINVNMTNMTMRADPATGYPGRTYRFYTGQTVFE
FGYGMSYTSFNITVVHAPELISVPLDEKYTCSPTQSESCETISLTNTKCDNMSLQVDVDVNNI
GNRDGSHVLFLFSTAPSNNVDAPNKQLIDFKKVYVEAGATERVIFTPDVCKDLSIVDKTGTRM
LPVGSRLLYIGDLEHSVSLQISS

Figure 29: Amino Acid sequence of 262. The conserved N and C terminal domains of family 3 ofThe Glycoside hydrolases are underlined.

MGLMENLVFVFVFCIVVFLKEGSLAQSVGNFPCSGQSSFPFCSTSLPIGDRVKDLVGRLTLP
EKVQQLVNTASAIPRLGIPKYEWWSEALHGVSNLGPGTRFGGSVPGATSFPQVIGTAASFNT
SLWQAIGQVVSTEARAMYNAGLAGLTYWSPNVNIFRDPRWGRGQETPGEDPVLASKYASN
YVRGLQDTDGGDPNRLKVAACCKHYTAYDVDNWSGVQRYTFNAIVTQQDLEDTYNPPFQS
CVADGNVASVMCSYNKVNGIPTCADKNLLAGTIRGKWNLNGYIVSDCDSVKVLFESQHYTPT
PEDAAADAILAGLDLNCGDFLGLHTEAAVKAGKLPESAVDAALVNIFTVLMRLGWFDGDPTK
QPYGNLGPKDVCTAEHQQLALEAARQGIVLLKNDGPLPLAANKVHSLAVIGPNANVTKTMIG
NYAGIPCKYTTPLQGLSAYTRTLYAAGCADVLCSGNNLLGAAVQTAGNADATVLIVGGDQTL
EKESLDRMDLLLPGQQQQLISQVAAASKGPVILVIMSGGPFDISFAKDNNKISGILWVGYPGQ
AGGAAIADVIFGAYNPGGRLPVTWYPQDFAAKIPMTNMNMRPDPATGYPGRTYRFYTGKTV
YMFGDGLSYTNFKHTLVHAPKLISLPMDGKHSCSHKSSNSCEAIRVTHTKCQNLFLEVHVEV
SNVGRREGGHVLFLFSSPPSKHHAPKKQLLGFRKLHLQAGAMEKVHFTLNVCKDLSIVDKTG
TRKLPVGSHLLHIGDVQHSVSLQISS

Figure 30: Amino Acid sequence of 263. The conserved N and C terminal domains of family 3 of The Glycoside hydrolases are underlined.

MKSLWWLVNIVMMMVLGAIAEEPPFACDSRNPATRSYAFCDSSKPITVRVEDLISRLSLVEKV
EQLTNNASAVQRLGIPKYEWWSEALHGVSQWGRGIHFNGPIHTATSFPQVILTAASFDVKLW
YHIAQAIGIEARAIYNAGQASGLTFWTPNINIFRDPRWGRGQETPGEDPLLSSRYSVAYVRGL
QGDPLSSSSKTNVRSSTHLRASACCKHFTAYDMDNWEGHTRFSFDAMVTKQDLLDTYQPP
FKSCVELGRASGIMCSYNSVNGVPTCGDFNLLTSTARRDWGFQGYITADCDAVATIYTSHRY
TPTAEDAVADVLKAGMDVDCGNYLGKYTMSAIAKRKVNESDIDRALRNLFSVRMRLGLFDG
DLNHQLEGKLKMRVVCSAEHQRLALQAARQGIVLLKNSRKHLPLSKTRTKSLAVIGPNANNA
TTLLGNYYGLPCHTITPLQGLQRYVRDTLYYSGCEDLACISNNLFGEAVEIAKKVDEVVVVVG
LDQTQEKEERDRIKLTLPGQQEKLVYQVSHAAKRPVVLVILSGGPVDVSFAVNDPQISSIIWA
GYPGQAGGQALAEIIFGDYNPGGRLPVTWYPQDFVKIPMTDMNMRPNHHTGYPGRTYRFY
TGKKVFDFGQGLSYSAYSYEFSSTTIKKIDLNVTMEHVETLGDTGKAHVRVENSPCRKLKFR
CSILVRNHDNMDGRHAVLLYSKSPATHKGAPQKQLIGFRSVHVPGKQTTNITFVVKPCDHFS
TVEENGQRLLAIGSHSLIVGDTQYSVSLVTKHSNRNP

Figure 31: Amino Acid sequence of 264. The conserved N and C terminal domains of family 3 of The Glycoside hydrolases are underlined.

MGPLAIAIADLLLWMLFLCCGIHGQPMFPCDSRIPNAANYPFCRTTLPIKDRVNDLIGRLTLKE
KAQHLVSRSGAVSRLGIPVYEWWSEALHGVSNVGPGTHFDPRSVPAATSFPQVILTAASFN
TALWEVIGQAVSTEARAMYNAGLAGLTYWSPNVNIFRDPRWGRGQETPGEDPLLSSKYATY
YVRGLQSPDGRNPNRLKVAACCKHYTAYDLDNWNGVDRFHFDAKVSQQDLEDTYNPPFKS
CVIDGHVASVMCSYNKINGVPSCADPKLLNGVIRGEWGLNGYIASDCDSVDVLYNTQHWTS
TPERAVADVINAGLDIDCGTFLGDHAEAAVRVGKLRESLIDEALSHSLTVQMRLGLFDGNPA
MQHYGNLGPRDICTNQHQQLALEAARQGIVLLKNNNRVLPLSATRIRSLAVIGPNADATNAMI
GNYAGIPCRYSTPLHALGKYTATIYKPGCENVACNRNLPLIHAAAQAASRADATVIIVGADQSI
EAEALDRVNLLLPGEQQQMVIETAAFSRGPVILVVMSGGPMDISFAKYNSKISSILWVGYPGE
AGGDALADIIYGHHNPGGRLPVTWYPQDFVAKAPMTNMNMRPDRATGYPGRTYRFYTGRT
VYPFGYGLSYTTFSHTLVNAPELVSLSLHDSPLMPYNGTNNSCTSVHVENTKCQGLLFDIHM
DVHNTGNRDGGHAVLLFFSPPTIHRSPQKSLMDFRKVHVGAGATERVQFSIDVCKDLSIVDEI
GVKKLALGSHILHVGDVQHSLNLQIE

Figure 32: Amino Acid sequence of 265. The conserved N and C terminal domains of family 3 of The Glycoside hydrolases are underlined.

MGPKAISNIAGLILWMLFLCCGIHGQPNFPCDSRIPNAASYPFCKTSLPIRARVSDLIGRLTLKE
KVQQLVSKSAGVPRLGIPSYEWWSEALHGVSNIGPGTQFAAGSVPAATSFPQVILTAASFNT
SLWEAIGQAVSTEARAMYNAGLAGLTYWSPNVNIFRDPRWGRGQETPGEDPLVVGRYGTY
YVRGLQSTGGKNRNRLKVAACCKHYTAYDLDNWNGFDRFHFDAKVTQQDLEDTYNPPFKS
CVMDGHVASVMCSYNKVNGVPTCADPKLLNGIIRGQWKLNGYIASDCDSADVLYNTQHWTT
TPERAVADVLGAGLDVNCGTFLGDHAEAAVKVGKVKEALINRALINSFTVRMRLGVFDGNPA
TQPFGNLGPRDVCSEQHQQLALEAAREGIVLLKNNNRVLPLFKTRTRTLAVIGPNADVTNVMI
GNYAGIPCRYTTPRQGLGKYATTIYKPGCQNVACQRNPTLIHDASQAASQADATVIIVGADQ
SVEREGLDRGSLLLPGQQEQMVLEVTAASRGPVILVVMSGGPMDISFARDSNKISSILWVGY
PGQAGGDALADIIFGHHNPGGRLPVTWYPQDFVTRVPMTNMNMRPDRATGYPGRTYRFYT
GKAVYPFGYGLSYTTFSHSLVHAPEMVSLSLHENQLLSCHGTNNSCNSVNVENTKCEGLLL
DVHLDVQNTGSRDGGHAVLLFSSPPAVHGAPQKNMVGFRKVHVGAGTTERVHFSIDVCKD
LSIADESGAKKLLLGSHLLHAGDVQHSLNLQIE

Figure 33: Amino Acid sequence of 266. The conserved N and C terminal domains of family 3 of The Glycoside hydrolases are underlined.

MRLLTVMSRQIQALCISIVLSLSIVIVISDSTDYACKEHDVNSVSYGFCNTSLPIKERVEDLIRR
MTLEEKVGQLSNGASDVQRLGIPRYEWWSESLHGIATNGPGVNFDGPITAATVFPQIILSAAS
FNSTLWFRTAQAIAVEARAMYNVGQAGLTFWAPNINIFRDPRWGRGQETPGEDPLLTSEFA
VAFVRGFQGENESHDTMEKSQRSRARRELKMEGLNSLQTEPSRLMLSACCKHFTAYDLDS
WQGHARYTFNAVVSEQDLKDTFQPPFQRCVQDGHASCMMCSYNQLNGVPVCANYDLLTQ
MTRNDWGLEGYITSDCDAVAIISEDQHYATCAEDAVTDVLKAGMDINCGTYLLRNTMSAIKQ
GKLHESVIDQSLFNLFSIRMRLGLFDGDPKQQEYGHLGPDHVCTNEHWQLALEGSRQGIVLL
KNIGNALPVSKNKINSIAVIGPNANATEEMLGDYIGIPCNPVTPFVALQNYIGNVSFSKGCENV
ACSSNAKFGEAVDIAAKADAVVIVVGLDLTQETEDHDRVNLTLPGQQQRLVSEVAVASKGPV
VLVLMCGGPVDVSFAKDDPRISSILWVGYPGEAGGQALAEIIFGDYNPGGRLPMTWYPQKFI
NVPMTDMNMRPNSSTGYPGRTYRFYTGETVFQFGEGLSYSNYSYKFSSKDGHIILPFSSPS
YGEWVSDYIDIDDIPCESFKFTTKLTVQNHGSMDGSHVVLLFSRYGGNFRGAPHEQLIDFKR
VHIVAGKTTDVSFLVNPCKHFGMVMEDGRRVLAIGNHELMVGDTRLSVSLKTSFLSRK

Figure 34: Amino Acid sequence of 267. The conserved N and C terminal domains of family 3 of The Glycoside hydrolases are underlined.

MGASAVPIAGLILWILFFRCGIHGELMFACDSRIPNAANYPFCSTALPIKDRVNDLIGRLTLEEK
IQQLVSKAAGVPRLGIPGYDWWSEALHGVSNVGPGTQFAAGSVPAATSFPQVILTAASFNIS
LWDAIGQAVSTEARAMYNTGLAGLTYWSPNVNIFRDPRWGRGQETPGEDPLLVSQYAANY
VRGLQLTDSLDTNRLKVAACCKHYTAYDLDNWNGADRFHFDAQVTQQDLEDTYNPPFKNC
VIDGQAASVMCSYNKVNGVPTCADPKLLNGVIRGEWGLNGYIVSDCDSAEVMYNTQHWTST
PERAVADIMESGLDVNCGNFLADHGEAAVKVGKLKETFIDTALFNSFTVQMRLGLFDGNPAF
QPYGNLGPGDVCSEQHQQLALEAARQGIVLLKNNNGALPLSPTQIRSLAVVGPNADVTNVMI
GNYAGIPCRYTTPLQGLGKYTATIHKLGCENVACQSNSILLSEASEAATQADATVIIVGADQTV
EAEMLDRVSLSLPGQQEQLVLDTADAARGTVILVVMSGGPMDISFARDNPKICGILWVGYPG
QAGGDALADILFGQHNPGGRLPVTWYPEEFAIKVPMTNMNMRPDPATGYPGRTYRFYTGN
SVYPFGYGLSYTTFSHSLVRAPKLVSLSLHESLLKSCRGMNNSCASVEVENTKCQGLLFDLH
AEVHNTGSRDGDHVLLLFASPPAIQGIPQKRLMGFRKVHVGAGGTERVHFSIDVCKDMSIVD
GNGVKQLLLGSHLLHVGDTKHTLRVEIE

Figure 35: Amino Acid sequence of 268. The conserved Glycoside hydrolase, family 5, domain is underlined.

MGHICSCKWQFLILLCFVFFPFAAPTEGRRLAQTPKVRGVNLGGWLVVEGWIKPSLFDDIKD
NDLLDGTKVQFKSAKLNTYVSAENGGGQNAVVNRDNASTWETFKMWRVSDGMYQLRVFS
GQFLTAENGGGGNMSAEADSPADWETFHIIRHHKHPNRVHIRVFNGMYMQAQSQEQLTAD
YQGDPGWHDNSATFQMIIVANDLHGDYQLANGYGRDKAKKVYHRHRSSFITDKDFKFLSRN
GINTVRIPVGWWIAYDPNPPAPFVGGSLQSLDNAFKWADHYGLQVIVDLHAAPGSQNGMEH
SASRDGSADWSNSSDHISQSLTVIDFLASRYSNNSMLLGIELLNEPLATTVPVDVLASYYSNG
YQTVRKYSATTYVIMCQRIGNADPHELYQINDAFSNIVVDVHYYNLFDDYFDNKTAQDNIDFIS
KNREPQVEALNSTNGPLIFVGEWTNEWKVQGASRSEYQQFGDAQLQAYEKASFGWSYWT
LKNEEKHWDFEWNIKHNYLRLGNSRATSNKSISWRIYAFLLIFGCIYV

Figure 36: Amino Acid sequence of 269. The conserved N and C terminal domains of family 3 of The Glycoside hydrolases are underlined.

MVSRMNSGWYVFLCVVILCKCAGAIGYARYKDPSQP<u>IDARVKDLLSRMTLEEKIGQMTQIER
TDATADVMKHYYIGSVLSGGGSVPAPKASPATWINMVDELQKGAMSTRLQIPMIYGIDAVHG
HNNVYGATIFPHNIGLGATRDPDLARRIGAATALEVRATGIQYTFAPCVAVCRDPRWGRCYE
SYSEDPKIVKAMTEIIVGLQGNPPANSTKGGPFIAGQSNVAACAKHFVGDGGTTKGIDENNTV
INYQGLFNIHMTPYFDAIAKGVSTIMVSYSSWNGQKMHANHFLVSQVLKKQLGFKGFVISDW
QGIDRITSPPDANYSLSVLDGVGAGIDMVMVPDNFTDFISDLTSQVKGGFISMSRINDAVQRIL
RVKFTMGLFEHPMADPSLANQLGSKEHRELAREAVRKS</u>LVLLKNGKSASKPLLPLDKNAPKI
LVAGTHPDNLGYQCGGWTIEWQGLSGNSTIGTTILEAIKFAVSPSTDVVYQQNPDANYVKGQ
GFSYAIVVVGEAPYAEMKGDNFNLTIPLGGGDTIKNVCGSLKCLVILISGRPLVIEPYLPLVDAF
VAAWLPGTEGQGVTDVIFGDHGFQGKLPRTWFKSVDQLPMNVGDKHYDPLFPLGFGLT

Figure 37: Amino Acid sequence of 270. The conserved N and C terminal domains of family 3 of The Glycoside hydrolases are underlined.

MDSIWCLFLFLVAFGKCADAAQYTLYKDPSQP<u>VSARVDDLLARMSLEEKIGQMTQTERSVAT
PDVMTNYYIGSVLSGGGSAPAPQASPATWMNMVDGLQKGAMATRLQIPMIYGIDAVHGHNN
VYGATIFPHNVGLGATRDPDLVKRIGAATALEIRSTGIQYTFAPCVAVCRDPRWGRCYESYS
EDPTIVKAMTEIIYGLQGQPPANSTKGVPYVAGQSNVAACAKHFVGDGGTTQGVDESNTVT
DYKQLVNIHMTPYFDAIAKGVSTIMVSYSSWNGHKMHANRFLISHVLKKQLSFKGFVISDWQ
GIDRITSPPNANYSLSVLESVGAGIDMVMVPFNFADFINDLTSQVKGGFIPMSRINDAVQRILT
VKFTMGLFEHPMGDPSLANQLGSKEHRDLAREAVRKS</u>LVLLKNGKSASQPLLPLNKNAPKIL
VAGTHPDNIGYQCGGWTIEWQGLSGNITIGTTILSAIQSAVSSSTEVVYQQNPDANYVKEQG
FSYAIVVVGEPPYTEMFGDNLNLTIPLGGGDTINNVCGSLKCLVILISGRPLVIEPYLPLVDAFV
AAWLPGTEGQGVTDVIFGDYSSQGKLSRTWFKSADQLPMNAGDQHYDPQFPLGFGLTTTV
AENISSSFGVL

Figure 38: Amino Acid sequence of 271. The conserved N and C terminal domains of family 3 of The Glycoside hydrolases are underlined.

MANRMDSGWCLLLFVVVLCRCAEAVEYAKYKDSSQP<u>IDARVDDLLARMTLEEKIGQMTQIER
TVATADVMKNYYIGSVLSGGGSEPAPQASPATWINMVDGLQKSALSTRLQIPMIYGIDAVHG
HNNVYGATIFPHNIGLGATRDPDLVRRIGAATALEVRATGIPYTFAPCVAVCRDPRWGRCYE
SYSEDPTVVKSMTQIILGLQGQPPAKYKRGIPFVAGESNTVACAKHFVGDGGTTDGINENNT
VISYDGLVNIHMAPYFDAIAKGVSTIMISYSSWNGVKMHANRFLVSQVLKKQLGFKGFVISDW
QGIDRITSPAGANYSLSVFDGVSAGIDMVMVPYNFMDFIGDLTSQVKSGLISMTRINDAVRRIL
RVKFTMGLFEHPMANPSLANQLGSKAHRELAREAVRKS</u>LVLLKNGKSDSKPLVPLDKNATKI
LVAGTHPDNLGYQCGGWTITWQGLSGNTTKGTTILEAIQSAVSPSTEVVYQENPDANYVKG
QGFSYAIVVVGEAPYAETAGDNLNLTIPLGGGDTINNVCGSVKCLVILVSGRPLVITPYLPLVE
AFVAAWLPGSEGQGVTDVIFGDYGFQGKLSRTWFKSVDQLPMNVGDKHYDPLFPFGFGLT
<u>TT</u>VAKNL

Figure 39: Amino Acid sequence of 272. The conserved N-terminal and C-terminal domains of glycoside hydrolases family 3 are underlined.

MDSGWYLLLFVVVLCRCAEATEYAKYKDPSQS<u>ITARVDDLLARMTLEEKIGQMTQIERTVAT
ADVMKNYYIGSVLSGGGSAPAPKASPATWMNMVDELQKGAMSTRLQIPMIYGIDAVHGHNN
VYGATIFPHNVGLGATRDPDLARRIGVATALEVRATGIQYAFAPCIAVCRDPRWGRCYESYS
EDPKIVKTMTEIIFGLQGQPPANSTKGVPFLAGQSNVAACAKHFVGDGGTTEGINENNTVISY
KGLVHIHMAAYFDAIAKGVSTVMVSYSSWNGGKMHANRFLVSRVLKKQLGFKGFVISDWQG
IDRITSPAGANYSLSVFDGVSAGIDMVMIPYNFKDFINDLSSQVKSGLIPMTRINDAVRRILRVK
FTMGLFEHPLGNPSLANQLGSKEHRELAREAVRKS</u>LVLLKNGKSANKPLLPLEKNASKVLVA
<u>GTHPDNLGYQCGGWTMEWQGLSGNITVGTTILEAIKLAVSPSTEVVYEQNPDANYVKGQGF
SYAIVVVGEAPYAETFGDNLNLTIPLGGGDTIKTVCGSLKCLVILISGRPLVIEPYLPLVDAFVA
AWLPGTEGQGVTDVIFGDYRFQGKLARTWFKSVDQLPMNIGDQHYDPLFPLGFGLV</u>

Figure 40: Amino Acid sequence of 273. The conserved Glycoside hydrolase, family 5, domain is underlined.

MAACINIHARNCPQGCFKFVILVLITSCLAYGSEASEVRRLTIGTQKYHSVALGGWLVIEGWIK
PSLFDGIPDNDLLDGTQIQLKSMKLGTYIVAENGGGQKVAVNRTNPLKWETFRIWRVRDGYY
QLRVFNKQFLGADNGGGGVVKAVATTPRSWETFQIIRNNADRNRVHLKALNGMYLQANSKD
QLTADFKGEPAWDGNNAATFEMSFTGHMQGEFQISNGYGPERA<u>AQVLKEHRSTFIREDDFV
FLSKQGISAVRIPVGWWIASDPKPPAPFVGGSLECLDKAFSWAQNHGIKVIIDLHAAPGSQNG
DEHGGGRDGYIEWADSQKNIDTTLSTIDFLASRYAAHPALLGIELLNEPRSSGISLNNLTAYYT
QGYNIVRKYSSSAYVIMCNRIGPVDPKELFQINNGLFRTVVDVHYYNLFDDSTFKHMTVQQNI
DYIKNTRAQTLQSLVSANGPLIFVGEWVAEWEVQNATQSDYERYGDAQFQVYGTASFGWT
YWTLRNIGNRHWDFQWMVNNQYLRLPSIQI</u>

Figure 41: Amino Acid sequence of 274. The conserved Glycoside hydrolase, family 5, domain is underlined.

MAAYIDVHAKKLSQRCFGFVITLLVFTSSLAYGRKILEARRLTNDTQKYHSVNLGGWLVIEGW
IKPSLFDGIPDKDLLDGTQIQLKSMKLGTYVVAEDGGGTIMAVNRTNPSGWETFSLWRARDG
YYQFRVFNKQFVGADNGGGGIVEAVATTPNSSETFQIIRNPANSNSVHIKVFNGMYMQAQSK
DQLTADFEGEPGWDDNNAATFEMTIVRTLQGEFQISNGYGPEKA<u>TQVLNEHRSTFITEDDFV
FMSKNGISAVRIPVGWWIASDPYPPAPFVGGSLACLDKAFSWAQNHDIKVIIDLHAAPGSQN
GDEHSGTRDGFIEWPESQENIDKSLSVIDFLAARYAAHPALLGIELLNEPRSPAVSLNNVTDY
YSRGYDIVRKYSSSAYVIMCNRIGPADPKELFQMNNGLSRTVVDVHYYNLYDDATFKNMTVQ
QNIDYIKTTRAQTLQSLVSANGPLIFVGEWVDEWELNSATQSDYQRYGDAQLQVYGEASFG
WAYWTLRNIGSRHWDLEWMVQNQYLLLPASNQS</u>

Figure 42: Amino Acid sequence of 275. The conserved family 17 glycoside hydrolase domain is underlined and the glycosyl hydrolases family 17 signature is in bold.

MGFIHTMAIPESKVFWLLLAIVGGVIHAYAEDYT<u>IGIDYGQLGDNLPSTEEAIHLIQRMKVGRV
KIYDTNPEILKALAHTGIKVSVMVKNEVIANVSANQSFADKWVKNNVVYFYPATKINIVLVGNEI
LSDYSNNQTWYQLVPAMLRIRRALVRYKLHHIKVGTPSAMDVLNTSFPPSSGAFRDDVAETV
MKPMLEFLTRTRSYFFIDVYPYFAWSSDPTNISLEYASFGDHDKNYTDPNGLVYTNLLDQQL
DAVVAAMSKLGYEDIRLIIAETGWPNAGDLNQLGANIFNSAHYNRRLIRRMLADPPLGTPRRP
NQFIPTYIFSLFNEDQKSGPGTERHWGLLYPNGTRVYEIDL</u>TGELQDSEYKPLPPPPPYTGK
LWCVVDANANVSSLPSAINYACSQGNNTCASIQPGKPCYQPNTVIDHASYAFNSYWQQFKN
SGGTCYFNGAATLVTQDPSRGSCTYPFT

Figure 43: Amino Acid sequence of 276. The conserved glycosyl hydrolases family 17 domain is underlined.

MRRRMGLLFSVLVMFVWVGWVRGLGVNWGTQASHPLPPDILVGLLKDNGIKKVKLFDAEER
AMRALAKSGIEVMAGIPNDQLQRMANSQKAAANWVEANATEFSLDGGVDIRYVAVGNEPFL
KAYNGTFIQYTFPALQNIQNALNKAGLKNIKATVPLNADVYQGDTPSEGQFRPDINDLMIQICQ
FLASNGAPFTVNIYPFLSLYTNENFPVDFAFFDGTGQPVIDGNIQYTNVFDAALDTLFWALKR
AGFPDLPVLVGEVGWPTDGDKHANINFAQRFNQGLLKHIMNGRGTPLRPQNIETYLFSLVDE
DAKSIAPGNFERHWGIFQYDGTPKYALDLSGQTQNTALVSAKGVKYLPRRWCVFNPSASPS
VLTQLPDSITYACTHGDCTSLGFGSSCNSLDYQGNASYAFNSYYQVNNQQNGACGFSSLAI
VTESDPSQGTCKFEIQIAVSAASNTMNSYL

Figure 44: Amino Acid sequence of 277. The conserved Glycoside hydrolase, family 17, domain is underlined.

MATNIILIVCIAIFCCSILAESAQIGVNYGMLGTSLPPAGQVVTLMKSNNIGKMKIFQADKDALK
AFANSGIEVIVGVGNNELQLISSSQDAANGWVNDNIRPFYPATNIKYIAVGNEVLIKTTYGSYL
VPAMRNIQTALQNANLQNNIKVSTTHSSDVSEGYPPSNGVFKDEVKDTMKSVLQFLLDHGSP
FMGNIYPYFSYINNRAQITLDYALFKSTSTVVPDKGRSYKYLFDALVDTLVSAMEALGYPNIPLI
VTESGWPSAEADVATVDNARTYNNNLIRHVLSNEGTPKRPGKSIETYIFALFNENKKNPGTE
QHFGLFYPNQQHVYPVNFSP

Figure 45: Amino Acid sequence of 278. The conserved Glycoside hydrolase, family 17, domain is underlined.

MATFKDQSRIFLIGCVAIFCCSVLADGDKIGVDYGMTADNLPSPDEVVTLMKSNNIGKTRIYQ
ENDVVLQAFANSGIDVIVGVANEELKNISSSQDSANRWVNEHIVPFYPATNVKYIAVGNEVLIT
LDNVQYVPYLVPAMNNIQTAIQNAKLQDSIKVSTTHRPDVSSGYPPSKGVFVDAVKDTMSQIL
NFLSQNGGPFMADVYPYFSYIGNTKDISLDYALFKSTSTVVQDGDHSYTNLFDAMVDTLLSA
MEASGYPNIPIVITESGWPSAGAEVATIENAQTYNNNLIKHVLSNAGTPKRPGMSIDTYVFALF
NEDLKPGDETEKHFGLFDPNTKQPVYSVNFSP

Figure 46: Amino Acid sequence of 279. The conserved Glycoside hydrolase, family 17, domain is underlined.

MKILSRFLLLLLLIASFSEVALGGPFVGVNIGTDVSNMPSASAVVALLKNQQITHVRLYDADRQ
MLTALANTGIEVVVSVPNNQLLGVGQSRSTAANWVNKNVAAYLPNTNITAIAVGSEVLTTIPN
AALVLVPAMRFLHSALVAANLDGQVKVSTPHPAELILDSFPPSQAFFNSSWNSVMIPLLAFLR
DTKSYLMLNVYPYVVYMQGNGVVPLDYALFRPLPPNKEAVDPNTLLHYTNVFDAVVDAAYY
AMASLNFTNIPVVVTETGWPSMGDANEPDATVDNADTYNSNLVRHVLNSTGTPKLPGVAVN
TFIYELFNEDLRPGGTSEENWGLFSANSTPVYVLHLNGAGSPLGNDTSAQTFCVALSGADN
QLLQAALDWACGPGQADCSAIQAGQSCYTPDTVADHASYAFDSYYHKMNMAPGSCDFNG
VGTITNTDPSHGSCIFQGSVSANGTSSVNGTVLGNETFPLTGTNITSLNSSAPHLQSQIHPILF
PLVALPILFWNLPIL

Figure 47: Amino Acid sequence of 280. The conserved Glycoside hydrolase, family 17, domain is underlined.

MGSLNRSMVCSMLISVFFCFVFGALHMVSADFANKQALGINYGQVANNLPSPAIAVQLMKSI
NVGYVKIYDADSQVLTALANTSLPLVITVANEDIPNIASGSSNADQWVQKNVLPYYPATQIFMI
MVGNEVLSNPQIQSTWSQLVPAMENLQASLVKHNLDDSIKVTTSVAMDALASSYPPSNGSF
KADIAASIMQPMLSFLNRTDSYFFVDAYPYFAWSSNPVNISLNYVLFGVSTTEILDGQLQYSN
MLDAQLDAVVAAMADLGFPQVKLAVSETGWPTKGAADEPGANVANAAKYNRRLVSRFSAS
PPVGTPRRPGAFIPVFVFALFNEDQKTGPVTERNWGVFYPNGTPVYNIDLSGGNQGSAYTPI
IRSGTNNNTFSAPAGAPASAAAPIPTAAPITTAAAPIPTAAPITTAAPTPSTLQQWCVAKSGVN
NMTAVQQALDYACGAGADCSAIQAGNACYQPNTVEAHASYAFNSYWQSTKSNGGTCYFN
GVAALTTSDPSFQGCSFPFQ

Figure 48: Amino Acid sequence of 281. The conserved Glycoside hydrolase, family 17, domain is underlined.

MASSNKVGVCYGMVANNLPLPDQVANLIRSRNIGKVRLFQAHHEAQRALQNSGGIEVIVGVG
NDELQKIASDQAAANGWVNDNIRQFYPATNIKYIAVGNEVFSSENRQHLPYLVPAMRNIQTA
VQNANLQSSIKVSTTHATSVLGNSYPPSQGEFADELKSSMSDVLNFLAENGSPFMANVYPYF
SYIYNQAQISLDYALFKSADPVVSDEGRLYKSLFDALVDSLISAMEKSGHPDIPIVITESGWPS
AGNEAATVENAQTYNNNLIKHVLSNAGTPKRPGQHIDTYIFALFNENLKGGDEPERHFGLFY
PDQNLVYPVNFSP

Figure 49: Amino Acid sequence of 282. The conserved Glycoside hydrolase, family 17, domain is underlined.

MWVLPLLLLLLFLFCPFILGARVNGGAFVGVNIATDLSNMPSPSQVVSLLQTQQIKHVRLYDV
ERDMLLALANTSIQVVISIPNNQVLAIGESNSSAANWVKKNVADYLPNTNITGIVVGNEVLTTL
PNAALVLVSAMKFLQSALVAANLDQQVKISSSHSSDIILDAFPPSQAIFNQSFNDIIGPMLEFLQ
DTGSYFMMNLYPYYTFMEGKGKVPLDYALFEPLTPDKEAVDPNTLLHYTNVFDALVDAAYYS
MGNLNYTNIPVVVAETGWPSDGDATEPYATINNADTYNSNLVIHVLNITGTPKRPTIPVNTYIY
ELYNEDLRPGPLSEQNWGLFFANSSPVYVLHLTDAGEFLANDTTNQTFCIAKPGADLKLLQA
ALDWACGPGEANCTAIQGGEDCFNPDTVEAHSSYAFDSYYHNTGMAAGSCDFKGVAIITTT
DPSHGSCVYPGSGGANQTSASKNNTSVSGSMDMGHMDNSVLMMLHILLLFLWF

Figure 50: Amino Acid sequence of 283. The conserved Nucleotidyl transferase is underlined.

MKALILVGGFGTRLRPLTLSVPKPLVDFANKPMILHQIEALKAIGVDEVVLAINYQPEVMLSFLK
AFETKLGIKITCSQETEPMGTAGPLALARDKLIDGSGDPFFVLNSDVISEYPLKQMIDFHTKHG
GEASIMVTKVDEPSKYGVVILDEETGKVERFVEKPKVFVGNKINAGIYLLNPSVLDRIELRPTSI
EKEVFPKIAQEKQLYAMVLPGFWMDIGQPRDYISGLRLYLDSLRRNTSDKLATGVNIVGNVIV
DSTAQIGEGCLIGPDVAIGPGCVIEAGVRLSRCTIMRGVRIKKHACVSGSIIGWHSTVGQWAR
VENMTILGEDVHVSDEVYSNGGVVLPHKEIKSSILKPEIVM

Figure 51: Amino Acid sequence of 284. The conserved Nucleotidyl transferase is underlined.

MSIGDRKSVAVIMVGGPTKGTRFRPLSLNLAKPLFPLAGQPMVHHPILACKKIPNLAHIYLIGF
YEEREFALYVSSISNELKIPVRYLREDKPHGSAGGLYHFKDLIMEDDPANIFLLNCDVCCSFPL
ADMLEAHCKYGGMGTILVIKVSAESANQFGELVADSVTGELLHYAEKPETFVSDRINCGVYV
FTPDIFLGIQDVSTQRKDRATMRRVSSFEALQSATKALPTDFVRLDQDILTPLAGKKKLYTYET
SDFWEQIKTPGMSLRCSSLYLSQYRLTSPELLAKSNGGRTATIVGDVYIHPSAKVHPTAKIGP
NVSISANARIGAGVRLIGCIILDDVELKENSIVMHSIVGWKSSIGRWSRVQGEANYTSKLGITIL
GEDVTVEDEVVVANCIVLPHKMLNMSVQEEIIL

Figure 52: Amino Acid sequence of 285. The conserved Nucleotidyl transferase is underlined.

MKALILVGGFGTRLRPLTLSVPKPLVDFANKPMILHQIEALKAIGVDEVVLAINYQPEVMLSFLK
EFEAKVGIKITCSQETEPMGTAGPLALARDKLDDGSGEPFFVLNSDVICEYPLKQMLEFHKKH
GGEASIMVTKVDEPSKYGVVILDEETGRVDRFVEKPKIFVGNKINAGIYLLNPSVLNMIELRPT
SIEKEVFPKIASKKQLYAMILPGFWMDIGQPKDYISGLRLYLDSLRRNLPKKLSFGAHIIGNVIV
DETAQIGEGCLIGPDVAIGPGCVIEAGVRLSRCTVMRGVRIKKHACVSGSIIGWHCTVGQWA
RVENMTVLGEDVHVCDEVYSNGGVVLPHKEIKSSITKPEIVM

Figure 53: Amino Acid sequence of 286. The conserved nucleotidyl transferase family domain is underlined.

MAGEGKVIAVIMVGGPTKGTRFRPLSLNIAKPLFPLAGFPMVHHPILACKKIPNLAHIYLIGFYD
ERLFSLYLSNVSSELKIPVRYLCEDKPHGSAGALFKFHDLLMEDNPKEIFVMHCDICCSFPLV
DMQMAHRNYGGIGTMLVKKVSTEATGKFGELVADPLTKELLHFAEKPETHVSDYINCGVYIF
TPDIFVTMQTLTPTRKERGIFRRLSSFESLEFSSPSVQKDVIRLDEDLFTPLVGKKMIYTFETS
DFWEQIKTPGMSLRCSSLYLKQYHMKTPELLSSADAIMTVNIIGDVYIHPSSKIHPTAKIGPNV
SISANARIGPGVRLRDCIILDDVEVQDNAIVMHAIIGWKASIGKWARVQGERNYGAKNGISILG
EAVTVEDEVVVLSSTVLPHKALNQSVQGEIIL

Figure 54: Amino Acid sequence of 287. The conserved nucleotidyl transferase family domain is underlined.

MKALILVGGFGTRLRPLTLSLPKPLVDFANKPMILHQIEALKEAGVDDVILAVNYQPESMMKFL
TEFEAKLGIRIQCSREIEPLGTAGPLALAKDKLIDGSGQPIFVLNSDVICEFPLKEMLEFHKSCG
AEASVMVTRVDEPSKYGVVVLDEETGRVKRFVEKPQMFVGNKINAGIYLLNPSVLDRIELKPT
SIEKDIFPRIAEENQLYAMVLPGFWMDIGQPRDYLTGLRLYLDYLRTKSDVLASGSQFQGNVL
IDESVQIGEGCLIGPDVSIGPGCIIEAGVRLSNCAIMSGVRIKKHACVSWSIVGWHSTVGQWA
RAENMTILGEDVHISDEIYSNGGVVLPHKEIKSNILKPEIVM

Figure 55: Amino Acid sequence of 288. The conserved Eukaryotic phosphomannomutase domain is underlined.

MDCRKAGVLALFDVDGTLTPARKVVSQEMLEFMQELRKVVAVGVVGGSDLAKITEQLGKTVI
SDYDYVFSENGLVAHGSKAIGNQSFKAFLGDEKLKELINFTLHYIADLDIPVKRGTFIEFRSG
MLNVSPIGRNCSQEERDEFERYDKVHGIRTKMVEVLREKFAPLNLTYSIGGQISFDVFPQGW
DKTYCLRYVENDFQEIHFFGDKTYKGGNDHEIFESSKTIGHTVTSPEDTRRQCTELFFQ

Figure 56: Amino Acid sequence of 289. The conserved group 1 glycosyl transferase domain is underlined.

MAGNEWMNGYLEAILDGGGVGDDNDYTRQKKESSVKSGVTVIPQLGAFNPARYFIDEVVHG
TDETDIHHFWVKVTATKNPEERNTRLENLCWRIWHISRRKKKGKLEQSKRLQKLRQERERG
RRDVTEDMSEDLSEGEKLGGDGQGLKFSESHYNLELLTEQSLKGKRLYVIMISLHGLVRGEN
MELGRDSDTGGQVKYVVEFAKALAKMPEVYRVDLLTRQICSPDLDS<u>SYGEPTEMLTSDQDD
DILESGGAYIVRIPCGCKEKYIQKELLWPYIPEFVDGALGHILNISKALGDLIGEDTPVWPHVIH
GHYADAGDAACLLSGALNVPMVLTGHSLGRNKLEQLLKQGLHSKEDINATYKIMRRIEAEEL
CLDSAELVVTSTRQEIEEQWGLYDGFDLELNRKLRQRAKRGVHSYGRYMPRMSVIPPGMDF
SNVVVHDENSDNDLDNDSVQLPESPLWGEIPRFLNNPSKPIILALARPDPKKNMATLVKAFG
ECIKLRKLANLMLIMGNRDDIDQMPAASANVLTTVLKLIDKYDLYGEVAYPKHHKQSEVADIYR
IAAKTKGVFINPALVEPFGLTLIEAAAHGLPMVATKNGGPVDIQRTLNNGLLVDPHNDKEIAAA
LYRLVVDKNLWVECRQNGLQNIHLYSWPQHCRTYLSRISQCRMRHPQWQSENDQNENMD</u>
SESDSGSFKDAPDTSLRLSLDADRPSRSSSVNSPFDLDKLLQNEENVGGISEHIRMIIEKTKD
NQSKLGDTNDVNSQEKQSIEHSNSLGSSGKHLLRRRKRLFVIAVDCYDASGEPLLSRQAIIIQ
EIMNAVCSAGNFSSPGFILSTALTVPETISMLQSIGIKVSAFDALICSSGSQLLYTAGDNPDSPI
YPDPDYDSHIDYRWGAEGLRKSMKKLRGPENSRFLAEDAEASNFHCLAYQVKNISTAPKAD
ELRRQLRMRGLRCHVIYTQNCSRLRVLPLHASRSQALRYLYVRWGLDIANMYVFLGEKGDT
GYEELIGGMHKTLILKGTVVDGSEKMLRS

Figure 57: Amino Acid sequence of 290. The conserved group 1 glycosyl transferase domain is underlined.

MAGNDWINGYLEAILDAGAGFTEAETRPALTVADGGGFNPTKYFVEEVVTGFDESDLHRTWI
KVVAMRNSLERNNRLENMCWRIWHLARRQKQIEWDDAQRLAKRRIEREQGRRDATEDMSE
DLSEGEKADVATPRATPKRAFSRNFSDLQVWSDDNKGKRLYIVLISLHGLVRGENMELGRD
SDTGGQVKYVVELARALSMMPGVYRVDLLTRQISSPDVDWSYGEPTEMLSSGSYDVDGHG
GGESSGAYIIRIPCGPRDKYIPKELLWPYIQEFVDGALGHILNMSKVLGDQAGKGDPVWPYVI
HGHYADAGDSAALLSGALNVPMVLTGHSLGRNKLEQLLKQGRQSKEDINATYKIMRRIEAEE
LSLDAAELVITSTKQEIVEQWGLYDGFDVRLEKILRARAKRQVSCHGRFMPRMVVIPPGMDF
SNVVVADQEPAEADGDLAALINGDVNLSPKALP<u>PIWSEVMRFFTNRHKPMILALSRPDPKKN
LTTLVKAFGECRPLKELANLTLVMGNRDDIDEMSGGNAAVLTTVLKLIDKYDLYGQVAYPKHH
KQSDVPDIYRLAAKTKGVFINPALVEPFGLTLIEAAAYGLPMVATKNGGPVDIHSTLTNGLLVD
PHDQKAIANALLELVADKNLWNECRRNGLRNIHLFSWPEHCRKYLSRVAVCRMRHPQWQT</u>
DTLMDTTMDEESMGDSLKDVQDMSLRLSVDGEKYSVNGSLDNSAEVDKLLAAKGDPETYN
QVKRILDKLKKGPPSSITQETEPKPDVNEPRAPANNVSVSNKYLALRKKRKLFVIAVDCYDDT
GNVSPRMLEIIQEIIKAVRSDATAARFAGLVLSTALTVDEILGMLNSGNILPHEFDALICSSGSE
LYYPTIPAYPDDGSNKKLCPDPDYDSHIDYRWGGEGLRKTMSLLTASERDGQEKQERVIFED
AKHSNAHCLAYVVKDSTRVRKVDEFRQRLRMRGLRCHPMFCRNSTQLHVIPLLASRSQALR
YLFVRWGLDVANMHVFVGETGDTDYEEMLAGLHK

Figure 58: Amino Acid sequence of 291. The conserved Glycoside hydrolase, family 16, domain is underlined.

MDTPLHLLFLLLASSAALASAN<u>FYNDVDITWGNDRAKILDNGQQLQLTLDRSSGCGIQSKQE
YLFAKIDIQMKLVPGNSAGTVTTFYLSSQGPKHDEIDFEFLGNLSGDPYILHTNVFAQGLGGR
EQQFYLWFDPTLDFHTYSVLWTSNQIIFSVDGSPVRVFKNRETELGKVDSNYHYPKTQAMR
VYSSLWNADDWATRGGLVKTDWTKAPFVASLRNFNAAATSSFDAAAEEVALESNQEQRQR</u>
LQWVRKNYMIYDYCADTKRFPQGPPPECK

Figure 59: Amino Acid sequence of 292. The conserved Glycoside hydrolase, family 16, domain is underlined.

MDTPLHLLFLLLASSAALASAN<u>FYNDVDITWGNDRAKIIDNGQELQLTLDRSSGCGIQSKQEY
LFAKIDIQIKLVPGNSAGTVTTFYLSSQGPKHDEIDFEFLGNLSGDPYILHTNVFAQGLGGREQ
QFYLWFDPTLDFHTYSVLWTSNQIIFSVDGSPIRVFKNRETEMGKVDNNYHYPKSQAMSVYS
SLWNADDWATRGGLVKTDWTKAPFVASFRNFSAATASSFDAAAEEAALESNQEQRLEWVR
KNYMIYDYCGDTKRFPQGPPPECK</u>

Figure 60: Amino Acid sequence of 293. The conserved Glycoside hydrolase, family 16, domain is underlined.

MEMGKPLLFLFLLISSSLLLIVSAN<u>FYNDVDVTWGNGRGQILDNGQQLQLTLDPTSGSGFQS
KKEYLFAKIDMQIKLVPGNSAGTVTAYYLSSQGPKHDEIDYEFLGNLSGDPYIMHTNIFAQGL
GNREQQFYLWFDPTLAFHTYSVLWTPNQITLSVDGIPVRVFKNRETELAKVDSNYHYPKSQA
MRVYSSLWNADDWATRGGLVKTDWTKAPFVASFSDFNAATSSSNFAGEGALDSNQGQKL
QWVRNKYMIYDYCADTNRFPQGLPAECK</u>

Figure 61: Amino Acid sequence of 294. The conserved Glycoside hydrolase, family 16, domain is underlined.

MDTPLLFLLLLISSTLLLTVSAN<u>FYNDVDITWGNDRAKILDNGQQLQLTLDRTSGCGFQSKEE
HLFAKIDMQIKLVPGNSAGTVTAYYLSSQGPKHDEIDFEFLGNLSGDPYIMHTNVFAQGLGNR
EQQFYLWFDPTLDFHTYSVLWTSNQIIFSVDETPVRVFKNRETELGKVDSNYHYPNSQAMR
VYSSLWNADDWATRGGLVKTDWTKAPFVASFSDFNAATSSSNFDGEDVLDSNEEQKLQWV
RKNYMIYDYCADTKRFPQGLPAECK</u>

Figure 62: Amino Acid sequence of 295. The conserved glycoside hydrolase, family 16, domain is underlined.

MDTGTPLLFLFLLITSSSLLVIVSAN<u>FYNDVDITWGDGRGKILDNGQQLQLTLDRTSGSGFQS
KNEYLFAKVDMQIKLVPGNSAGTVTAYYLSSQGPKHDEIDYEFLGNLSGDPYIMHTNIFAQGL
GNREQQFYLWFDPTLAFHTYSVLWTPNQITFSVDETPVRVFKNRETELGKVDSNYHYPKSQ
AMRVYSSLWNADDWATRGGLVKTDWTKAPFVASFRNFSAATSSSNFAAEEALDSNQEQKL
QWVRNNYMIYDYCADTKRFPQGLPAECK</u>

Figure 63: Amino Acid sequence of 296. The conserved Glycoside hydrolase, family 16, domain is underlined.

MQTHHSESSLLLLVLAFEIALFFLIFNRLLSIIITDMDTPLLFISLLSLASLVVTVSAN<u>FYNDFDIT
WGNDHAQILDNGNQLQLTLDHTSGCGCQSKEEYLFAKIDMQIKLVPGNSAGTVTTYYLSSQ
GPKHDEIDFEFLGNLSGDPYVMHTNIFAQGLGNREQQFYLWFDPTLDFHTYSVLWTPNQIIF
SVDGTPVRVFKNREKELGNNFHFPNSQAMRIYSSLWNADDWATRGGLIKSDWSKAPFVAYF
SNFSAVISSSNFVIEEDLDSNQEQKLQWVRNNYMIYDYCADTKRFPQGLPPECK</u>

Figure 64: Amino Acid sequence of 297. The conserved Glycoside hydrolase, family 16, domain is underlined.

MDMGMPLLFLFLLITSSSLLVTVSAN<u>FYNDVDITWGNGRGKILDNGQQLQLTLDRTSCGFQ</u>
<u>SKNEYLFAKIDMQIKLVPGNSAGTVTAYYLSSQGSEHDEIDYEFLGNLSGDPYIMHTNIFAQG</u>
<u>LGNREQQFYLWFDPTLDFHTYSVLWTPNQIFSVDGIPVRVFKNRETELGKIDSNYHYPKSQA</u>
<u>MRIYSSLWNADDWATRGGLVKTDWTKAPFVASFSNFSAATSSSNFAGEEALDSNQEQKLQ</u>
WVRKNYMVYDYCADTKRFPHGLPAECK

Figure 65: Amino Acid sequence of 298. The conserved Glycoside hydrolase, family 16, domain is underlined.

MMLAVALVCIWVCGLFSQPGSAVGSSRPRLAGKLVTENFAGLQ<u>FEEAYTSLFGDENVKVAE</u>
<u>DGKTVMLSLDKRTGSGLLSQDMYLYGLFSASMKLPDDYTAGVVAAFYTSNGDMFPGTHDEL</u>
<u>DFEFLGNIRGKEWRIQTNVYGNGSTAYGREERYTLWFDPTEDFHQYTILWTEKSTVFFVDDV</u>
<u>PIREIPRTDAMGAHYPGKPMSVYATVWDGSDWATKGGRYRVNYKYSPFVVTLANLILEGCA</u>
<u>VDPLEQFPAVSCSADTTSSASLSKLAELSEDQKALMEWFRGKYISYSYCDDAVRYPSNPSD</u>
<u>CPPRDPHKKIATAHVKFGHHQRHHKKNRKSRRSSSSSAASAAVSL</u>

Figure 66: Amino Acid sequence of 299. The conserved glycoside hydrolase, family 16, domain is underlined.

MMLAVALVCIWVCGLFSQPGSAVGSSRPRLAGKLVTENFAGLQ<u>FEEAYTSLFGDENVKVAE</u>
<u>DGKTVMLSLDKRTGSGLLSQDMYLYGLFSASMKLPDDYTAGVVAAFYVSNGDMFPGTHDEL</u>
<u>DFEFLGNIRGKEWRIQTNVYGNGSTAYGREERYTLWFDPTEDFHQYTILWTEKSTVFFVDDV</u>
<u>PIREIPRTDAMGAHYPGKPMSVYATVWDGSDWATKGGRYRVNYKYSPFVVTLANLILEGCA</u>
<u>VDPLEQFPAVSCSADTTSSASLSKLAELSEDQKALMEWFRGKYISYSYCDDAVRYPSNPSD</u>
<u>CPPRDPHKKIATAHVKFGHHQRHHKKNRKSRRSSSSSAASAAVSL</u>

Figure 67: Amino Acid sequence of 300. The conserved Glycoside hydrolase, family 16, domain is underlined.

MARIIPIVLASAILLVASLQSEVNAANQI<u>FNADFQILFASDHVKTSDDGQIWELMLDKKSGSGF</u>
<u>QTKNSYRFGFFTMKLKLVAGDSAGVVTTYYMASKDFETRDELDFEFLGNVSGQPYALQTNIY</u>
<u>VNGVGGREQRNELWFDPTADFHTYSFLWNDHQLIFFVDLVPLRVHRHTNVTDNVYPKNRP</u>
<u>MSLLSSIWNADNWATRGGLDKTNWSYAPFISSYQNFNADACMWEDPFPACVSTTGENWW</u>
DKPPAWTLTDAQKLDYAWARRNFLIYDYCQDTKRFNGTLPVECSVGPW

Figure 68: Amino Acid sequence of 301. The conserved Glycoside hydrolase, family 16, domain is underlined.

MGLVGRMMHWPCVLGSIVVLCSLIVGSQCAA<u>FNDFFYPSWALDHVMYEGELLKLKLDNTSG</u>
<u>AGFASKSTYIFGKVNVQIKLVPEDSAGTVTAFYMSSQGDQHDEFDFEFLGNTSGEPYAVQTN</u>
<u>VFSKGVGKREQRIFLWFDPTTDFHSYSFLWNRQQVVFFVDDVPVRVFGNNEKVGVPYPQS</u>
<u>QPMGVYSSIWNADDWATQGGLVKTDWSHAPFVSTYTNFSIDACDYSLKTTCSSWWDEPAY</u>
ASLDAKQRLKLKWVQEKYMTYDYCKDSARFPTPPPECSA

Figure 69: Amino Acid sequence of 302. The conserved Glycoside hydrolase, family 16, domain is underlined.

MCLQRICWVRAMLIKMVPKLLLVLLVAAMAAMAASPPKPVDVP<u>FPKNYVPTWAADHIKYING
GNEVQLSLDKWTGTGFQSKGTYLFGHFSMQIKMVPGDSAGTVTAFYLSSQNAEHDEIDFEF
LGNRSGQPYILQTNVFSGGKGNREQRIYLWFDPTKDYHAYSVLWNMHQIVFFVDDVPIRVFK
NSRDLGVRYPFNQPMKIYSSLWNADDWATRGGLEKTDWSKAPFVASYRGFHVDGCEASVT
ESTCATQGRRWWDQKAFDDLDGMQWRKLKGVRNSYTIYNYCADKVRSPAMPPECTRDRD
I</u>

Figure 70: Amino Acid sequence of 303. The conserved Glycoside hydrolase, family 16, domain is underlined.

MLINMVPNVLLFLLVAAMAATATPPPKPVDVP<u>FQKNYVPTWASDHIKYINGGNEAQLSLDKW
TGTGFQSKGSYLFGHFSMQIKMVPGDSAGVVTAFYLSSQNSEHDEIDFEFLGNRSGQPYILQ
TNVFSGGKGDREQRVYLWFDPTKDYHSYTVLWNMHQIVFFVDDVPIRVFKNSKDLGVRYPF
NQPMKIYSSLWNADDWATRGGLEKTDWSKAPFVASYKGFHVDGCEASMPHSACPTLGRR
WWDQKAFDDLDGQQWRKLKWVRDRYTIYNYCTDRVRYPKMSPECTRDRDI</u>

Figure 71: Amino Acid sequence of 304. The conserved Glycoside hydrolase, family 16, domain is underlined.

MGGTWRTVGLSFLFLVFSSLIASVCSQSQGDDSSAKV<u>FDDNFQIMWAEDHFRTSENGQVW
HLVLDQNSGSGFKSKYKYRFGWFSMKLKLVPGDSAGVVTAYYMSSNTDMNRDELDFEFLG
NRSGEPYALQTNIYAKGVGGREQRHILWFDPTTQFHTYSILWNSHQIVFFVDQVPLRVHRHT
EATSDVFPKEQGMYMFSSIWNADNWATRGGLEKTNWTAAPFVSSYKKFHGLGCKWGDDN
TTLLPCANDKNASASHWWDEAVAWTLTKKQRENYRWVNSKYLLYDYCNDQSRYSIKPVEC
SVAPWD</u>

Figure 72: Amino Acid sequence of 305. The conserved glycoside hydrolase, family 16, domain is underlined.

MGRTWRAMGMSFLVLVLIGLIACVSCQSDGDDSSPKV<u>FDDNFQILWAQDHFRTSENGQVW
HLVLDQNSGSGFKSKNKYRFGWFSMKLKLVPGDSAGVVTAYYMSSDTDMNRDELDFEFLG
NRSGQPYGLQTNIYSNGVGGREQRHILWFDPTTEFHTYSILWNAHQIVFFVDQVPLRVHRHT
KATRHVFPRKQGMYMFSSIWNGDNWATRGGLEKTNWAAAPFVSSYKKFHGLGCKWEDQN
TTQSSCAHSNNASARHWWDKPEARTLTKKQREYYRWVNSKYLTYDYCHDQPRYPIKPVEC
SVAPWD</u>

Figure 73: Amino Acid sequence of 306. The conserved Glycoside hydrolase, family 16, domain is underlined.

MAGQRNWFKRIEFIVIFVVCLNSVSARPAS<u>FAEDFKVTWADDHVKTRSDNNSIDLILDQNSGA
GFASKNQYMFGLVSMNIKLVAGDSAGTVTAFYMSSDKEEVRDELDFEFLGNRSGQPYTVQT
NVFALGKGGREQRVNLWFDPSLEFHRYSILWNHYHIVFSVDDIPIRVYKNNEARGVPFPKNQ
SMGIFSTLWEADNWATRGGLEKIDWSK</u>APFVASYRGFEIESCQYPGNASCVVNTSNWWEG
LSYSGLRPNQARLYKWVRTNYMIYDYCKDTPRYPVLPTECNAGI

Figure 74: Amino Acid sequence of 307. The conserved glycoside hydrolase, family 16, domain is underlined.

MEVSSASCLRGYVHFLLTAIICTAISPTVYAD<u>IYSDIDVTWGENNAWVLNNGQGLQLSLTNYS
GSGFQSYKEFLFGSVDISMKLVPGNSAGTVTTYYLSSTGEGHDEIDMEFLGNVSGEPYILHT
NIYVNCSADKEQQFYLWFDPTADFHNYSILWNPQQIAIFVDGLPIRVFANNENIGVPYPNEQA
MRVFSSIWNGDQWATQGGRVKIDWSSSPFVASYMNFNTDVCEWNGNGSTSQCWATNWW
NQNNLNYGQQGQLQWVRSNYLIYDYCKDYARFNYQLPAECAQQPQ</u>

Figure 75: Amino Acid sequence of 308. The conserved Glycoside hydrolase, family 16, domain is underlined.

MCSEAMKTAQFLGLFLILLLHSAAMAATPKPVSVP<u>FGKNYGASWGSDHIKEFHGGRKVELLL
NKQYGAGFESKGTYLFGHFSMQIKLVPGDSAGTVTAFYLSSQTAEHDEIDFEFLGNRSGQPY
ILQTNVFTGGKGEREHRIYLWFDPTKDYHSYAVLWNMYQIVFFVDSVPIRVFKNCKNLGIRFP
FNQPMKIYSSLWNADNWATRGGLEKTDWSKAPFTASYKQFHVDACEASVSESVCATQGRR
WWDQVEFRDLDGRQWRFLKWVRKHYTIYNYCTDAARNKKMPPECVRDRDNI</u>

Figure 76: Amino Acid sequence of 309. The conserved glycoside hydrolase, family 16, domain is underlined.

MYDCKRQNTIKPFTGHFHALLVLAFVLIVSVCPNADHVRVSEAARRGHKGRYPRASQFPTVA
<u>FNRGFHVLWGPQHQTIWNDQSGITIWLDRNSGSGFKSLRPYKSGYFSAAIKLQAGYTAGVN
TAFYLSNNEAHPDYHDEIDIEFLGNIPGRPYTLQTNIYVRAGNAGRGRIITGREQQIHLWFDPT
KDFHRYSILWTPLKIIFFVDDIPIRKYRRTNPYTFPARPMWLYGSIWDASPWATDNGKYKVDY
SYQPFVAQYRGFVLA</u>

Figure 77: Amino Acid sequence of 310. The conserved glycoside hydrolase, family 16, domain is underlined.

MAGYEGRRICIYWWVITVMLCRLVVGSQCAA<u>FNDLFYASWAADHVMSQGDLLQLKLDHTSG
AGFASKSTYLFGKVNVQIKLVPGDSAGTVTAFYMSSQGDQHDEFDFEFLGNTSGEPYVVQT
NVYSNGVGNREQRIYLWFDPTANFHSYSFLWNRHQSVFFVDDVPIRVFSNNEKRGVPFPQT
RPMGVYSSIWNADDWATQGGRVKTDWSHAPFISTYTSFNIDACKYSPGSSCTSWWDQPAY
ASLTAKQRMQLKWVHEKYMIYDYCKDPVRFGTPPAECTA</u>

Figure 78: Amino Acid sequence of 311. The conserved Glycoside hydrolase, family 16, domain is underlined.

MSTNGAYLWALVWASVISAGLGLGNGN<u>FDDDFYIMWAPDHVTRLYNGHGVQISMDRQSGS
GFATKKQYLFGKFEMQIKLPPGNSAGTVVAVYLYSNQPNRDEIDIEFLGNVDGKDIIMQTNVF
ANGYDDREQRIKLWFDPTADFHTYTIFWNRYHIVFLVDGFPIRVHQNNAVRGIPFPRMQPMS
LYTTIWNGESWATNGGKTKITWEP</u>YPFVAQFRNFYIDGCEWNGNPRFCKGGSTQNWWNK
RTYAYFNAGDRLKLHWVRKHYLVYDYCNDKVRFKVAPEECRYHI

Figure 79: Amino Acid sequence of 312. The conserved glycoside hydrolase domain of family 16 is underlined.

MAFIRKLPLLVLAFMLVLSVAHIQVSEAAGRPQSSHGTAYPLRSQLSAVK<u>FNQAFDVLWGPQ
HEQVSNDESGITIWLDRNSGSGFKSQRAYDSGYFSAAIKLQAGYTAGVNTAFYLSNNEVHPD
SHDEIDIEFLGTIPGQPYTLQTNIYVRAANGGTERIITGREQQIHLPFDPTSDFHRYSILWTPSKI
VFSVDNVPIRKYSRTGSAFPTRPMWLYGSIWDASSWATDNGKYKVDYNYQPFVARYTDFIL</u>
TDCTQSRAAECS

Figure 80: Amino Acid sequence of 313. The conserved Glycoside hydrolase, family 16, domain is underlined.

MEAPNLSGYLHLVLMIVIIWSTGIYPTVHAN<u>FYNDIDIAWGYNNVNIFDNGEELQLSLNNASGS
AFQSKAQFLFGSVDMFMKLVPKNSAGTVTTFYLSSTGDRHDEIDLEFLGNVSGQPYILHTNIY
TNGSGNREQEFYLWFDPTSEFHNYSILWNPQQIVLFVDGLPIRVFGNNEDIGVPYANGQAM
RAYSSIWDGDSWATQGGRVKIDWSYSPFVASYRNFTADVCEWTGSGSSSQCWANIPSNW
WNQAAYESLTYAQQGQLQWVRNNFLVYDYCKDPARFNNQLPAECYRQP</u>

Figure 81: Amino Acid sequence of 314. The conserved Glycoside hydrolase, family 16, domain is underlined.

MGTSGTSSQYSSSAFLQPRSCMNIIAVLIIFTLLNSIIPVHGESEKHIPVTSRFQTIN<u>FYNGYSNL
WGPQHQQVSEDESSTTIWLDSSSGSGFKSLEAYKSGFFSAAIKLQAGYTAGVIAALYLSNNQ
EYPGHHDEIDIEFLGTTPGKPYTLQTNVYINGTGDGQVLTGRELKFHLWFDPTEDFHNYSLL
WTPSYIIFYVDDIAIRKYPRRISSTYPLRPLWVYGSIWDASSWATENGKYRADYRYQPFVAKF
SKFILSGCPVSDSTCSATFSNSLISTGTGGLTSQERSRMKSIQTNNLVYNYCKDRERYPTRLP
ECGKRYAPSLINGND</u>

Figure 82: Amino Acid sequence of 315. The conserved glycoside hydrolase, family 16, domain is underlined.

MAFVGCQEGGRVMHCALLCIFVTLCNLLVSSQCAS<u>FDDFFYPSWAVDHVMSQGELLQLKLD
NISGAGFASKSTYIFGKANVQIKLVPGDSAGTVTAFYMSSQGDQHDEFDFEFLGNTSGEPYA
VQTNVYSKGVGNREQRIFLWFDPTADFHSYSFLWNRQQVVFFVDDVPVRIFSNNEKRGVPY
PQTQPMGVYSSIWNADDWATQGGLVKTNWSHAPFISTYKNFSIDACQYSSKTNCSSWWDQ
PGYASLDAKQRLKLKWVHEKYMTYDYCKDSARFPTPPAECE</u>

Figure 83: Amino Acid sequence of 316. The conserved Glycoside hydrolase, family 16, domain is underlined.

MASTGSQDDSAYRYTTIIRKQGHYQKHGSRHHLSASTGIQVVMVMAFFLVSSSSAARISSRP
LLRDQNRTATTVD<u>FDQNYDITWGNQLVKFLDNRRSVELRMDQSSGSGFASKNKYLFGYFST
RIKLVPGDSSGTVTAFYLSTQQTSKHDEMDFEFLGNKPGKPHYLSTNVFVNGVGNRESRIRL
WFDPTADFHTYSLLWNRHQILFMVSGVVVRVFKNSETSLGVPYPSSKPMQVIASLWNGENW
ATDGGKSKINWKQSPFIATFEGFDIEGHKCEGDSESSPFCPSSPSSEWWEDLGSKGLSAEQ
MRQLRWVRRNYMDYDYCTDKTRFPKPPPECALNTI</u>

Figure 84: Amino Acid sequence of 317. The conserved Glycoside hydrolase, family 16, domain is underlined.

MLREAMKTAQFLGLFLILLLHSAAMAATPRTPVSVPFGNNYVASWGADHIKEFHGGRKVELL
LNKQYGAGFESKGTYLFGHFSMQIKLVPGDSAGTVTAYYLSSQTAEHDEIDFEFLGNRSGKP
YILQTNVFTGGKGEREHRIYLWFDPTKDYHSYAVLWNMYQIVFFVDSVPIRVFKNCKDLGVR
YPFNQPMKLYSSLWNADDWATRGGLEKTDWSKAPFLASYEQFHVDACEASAPQSACATQ
GRRWWDQEEFRDLDGRQWRYLKWVRKQYTIYNYCTDISRNAKMPPECVRDRDNE

Figure 85: Amino Acid sequence of 318. The conserved Glycoside hydrolase, family 16, domain is underlined.

MKRRAKLLGFGINWRKIVYISSVVNLILSSVESSSFNDNFDISWGTVQLLNNGQTAQLTMDKA
SGSGFQSKDEYLFGSLSMSIKLVSGNSAGTVTSYYMSSDAASHDELDYEFLGNLPGNPYTL
QTNVFANGVGNREQRLNLWFDPTADFHNYSILWNHNQIVFWVDSIPIRVFKNNEETAGIPYP
NSRPMRILSTLWNGENWATDGGRVKIDWSKAPFVASYQSFEVNACSAPSNSSLPCANNWW
EQPEFQSLDESQLGKLDWVRKNYMTYDYCHDTSGRFSTTPAECAFNA

Figure 86: Amino Acid sequence of 319. The conserved Glycoside hydrolase, family 16, domain is underlined.

MKSHISLLGSRRSSPELVYLSLLILNLCTVKATFSDNFEISWGNVRLLNNGQTVQLTMDKASG
SGFQSKMDYLFGSLSMRIKLISGDSAGTVTSYYMSSEASQHDELDYEFLGNLPGQPYTMQT
NVFASGIGNREQRLKLWFDPTADFHNYSILWNQKQIVFWIDSIPIRVFKNNEAAGVPYPDQRP
MKIISTLWNGEDWATDGGRVKIDWNDAPFIASYQSFEVDACSSSPCVNDWWDQSTFQSLN
QQQLTQLDWVRKNYMTYDYCNDASRYPTPPRECALNP

Figure 87: Amino Acid sequence of 320. The conserved Glycoside hydrolase, family 16, domain is underlined.

MATSFSFYKLVLVVALLLTNGANVVVMLVSADQSLQPPLPSQPVTRYFKTMAFDEGFSNIWS
PDHQNVSQDRNSVTLKIDRYSGAGFKSKKTYLYGFFNAALKLQAGYTAGIVTTFYLSNSDVY
PDLHDELDFEFLGTIPGEPYTLHTNIYGNGSGDGNITSRIGREQRFHLWFDPTQEFHNYTILW
TPHQIMFFVDSIPIRQFRKLKSVRKQYPGKPMSIYATVWDGSDWATDGGKHRANYSYEPFLS
TYTNFIISGCTAGQPDCKPGRLDHRFPPILSKAQKEDLHFVRKNYMIYDYCHDTSRYPKGLPE
CPRSFPRRSPVFRPRHV

Figure 88: Amino Acid sequence of 321. The conserved Plant disease resistance response protein domain is underlined.

MAAPKSSNLSLLALIILLMGGTHHAVGMDLKKTEIEFYMHDVVTASKNFTTMKVAHSPEFGMI
RVIDNALTEDLQQNSKELGRARGMYVQDSFSGVNLLMVLTVIFQAGEHSGSTLCLQGQDGR
KQREISVVGGTGHFRHATGHAILEKQLSMGENAILNFNVTVLHRSELAE

Figure 89: Amino Acid sequence of 322. The conserved Plant disease resistance response protein domain is underlined.

MATKGFLETTIAVSAVLLLVCLHIAEAEVKTKLGREKISHLHFYFHDVVTGKNATAVQVASAPT
TKYSPTGFGAVVVMDDCLTAGPEATSKLVGRAQGIYVSSGQEDFHLLMATTFVFESGMYNG
STLAMIGKNAPLEEVREMPIVGGSGLFRFARGYALAHTHSIDGTTAVVKYNVTVLHY

Figure 90: Amino Acid sequence of 323. The conserved Plant disease resistance response protein domain is underlined.

MANKGYSAATITVAAVLLLSLFYLEAEAEAEAKLKLGREKISHLHFYFHDLVAGKNVTAVKVAS
APTTNSSATLFGAVMVMDDWLTEGPEATSKMVGRAQGIYVSSSQEDFHLLMATTFVFESGK
YNGSTLAMIGKNAALEQVREMPIVGGSGLFRFARGYALARTHAFELNTGNAVVEYNVTVLHY

Figure 91: Amino Acid sequence of 324. The conserved plant disease resistance response protein family domain is underlined.

MGPRFLFLAIIANVLLMFAAGEGEVNMVFYLHDNLTGTNVTAVPVAGLNGSSSNAGKFGTVV
TISDVITRRPEISESDSDNIIGRAQGMYVDTNPVTGLDFLMVFTLIFEDKKYRGSTLEFQGTDR
FAQPRREFAVVGGTGKFRFARGYAVANTESLSGVNAIIKFNGTIRTD

Figure 92: Amino Acid sequence of 325. The conserved Plant disease resistance response protein domain is underlined.

MKGFSAVNTAMAAVVLLVCLYLAVAEAKVKLGPEKISHLHFYFHDLVDGTNVTAVEVASAPTT
DSYFTQFGLVRVMDDPLTEEPKATSKMVGRAQGIYVSSCQHRVQLLMATTFIFESGKYNGS
TLAMVGKNAVFDDVREMPILGGSGLFRLARGYALARTHSLDLKTGNAVVEYDVTVVHY

Figure 93: Amino Acid sequence of 326. The conserved Plant disease resistance response protein domain is underlined.

MAIKGYSSVNITVAVYCYWFVLYLAAAEAEEKIGHGKISHLHFYFHDLVGGKNVTAVEVASAP
TTDSYFTQFGLVRVMDDRLTKGPKVTSKMVGRAQGIYVSSCQHRLQLLMATTFVFESGKYN
GSTLAMVGKNAVFDEVREMPIVGGSGFFRLARGYALARTHSFDLNTGNAIVEYNVTVLHY

Figure 94: Amino Acid sequence of 327. The conserved plant disease resistance response protein family domain is underlined.

MAIKKYNRDVHLCFVCLVLFTVMLQTSNGHRWKKHSLPKPCRNLVLYFHDVIYNGSNAKNAT
STLVGAPQGANLTLLAGKDNHFGDLAVFDDPITLDNNFHSPPVGRAQGFYFYDMKNTFSSW
LGFTFVLNSTDYRGTITFSGADPILTKHRDISVVGGTGDFLMTRGIATISTDAYEGDVYFRLCV
NITLYECY

Figure 95: Amino Acid sequence of 328. The conserved plant disease resistance response protein family domain is underlined.

MAIKNHNTAVHLGFIWLVVFSAMLLQSSDAHSYMKRPLPKPCRNLVLYFHDVIYNGLNAMNA
TSTLVGAPQGANLTLLAGRDNHFGDLAVFDDPITLDNNFHSPPVGRAQGFYFYDMKNTFSS
WLGLTFVLNSTDYKGTITFSGADPILKKYRDISVVGGTGDFLMARGIATISTDAYEGDVYFRLC
VNITLYECY

Figure 96: Amino Acid sequence of 329. The conserved Plant disease resistance response protein domain is underlined.

MGSRVLLPAMATATIVIFLLHAAAGERETNLVFYMHDNVSGNNVTAFTVAGLNGTSSDPGKF
GTIVVNWDAATKGAQATGTADPDNIVGRIQGMYVNTNLVTGLDFLMLFTVIFEDMEYKGSTL
EFHGTDKFFAPHRELAVVGGTGKFRFARGYAILTTEVLSGPNAVVKFNTTLRY

Figure 97: Amino Acid sequence of 330. The conserved Plant disease resistance response protein domain is underlined.

MRKFNDNARSNINNIAVA<u>AATTFLFWVALTIFERHEMKEKTSYLQFYFHDIVSGKNVTAVEV
ASSPTTGSSFTEFGLVRVMDDWLTEGPEPTSKMLGRAQGIYVSSCQEKVHLLMTLTFVFDS
GKYNGSTLAVVGKNAVFDEVREMPIVGGSGFFRFARGYALARTHSLDLTTGNAIVKYNVTVF
HY</u>

Figure 98: Amino Acid sequence of 331. The conserved Plant disease resistance response protein domain is underlined.

MAIENNNRAVYLC<u>FVWLLLFTVLLQASDGHGWNKDPFRRPSRNLVLYFHDVIYDGTNAKNAT
ATLVGAPHGANLTHLTAKDNHFGDLAVFDDPITLDNNFHSPPVGRAQGFYFYNMKNTFNAW
LGFTFVLNSTHYKGTITFAGADPILTKYRDISVVGGTGDFLMARGIATISTDAYEGDVYFRLRV
NITL</u>YEWY

Figure 99: Amino Acid sequence of 332. The conserved plant disease resistance response protein family domain is underlined.

MAIKNNNRAVYLCFLIWLLV<u>FTLSLRSSDGHGWNKYPFRRPSRNLVFYFHDVIYDGTNAKNA
TSTLVGAPHGAKLTHLAAKDNHFGDLAVFDDPITLDNNFHSPPVGRAQGFYFYDMKNTFSA
WLGFTFVLNSTDYKGTITFAGADPILTKYRDTSVVGGTGDFLMARGIATISTDAYEGDVYFRL
RVNITL</u>YEWY

Figure 100: Amino Acid sequence of 333. The conserved Plant disease resistance response protein domain is underlined.

MAKLSAGVASNVNSIAVA<u>ATLLLLLLALTAEAKEGYDSKVEEKTSDLHFYFHDTVSGKNVTTM
QVARASGTNSSPTLFGLAVVLDDIVTKGPEPASQLLGRMQGLYTLSGLEERAMQMVVTLVFS
SGQYNGSTLSLVGINRIYHPVREIPIVGGSGLFRLARGYVLARTHSLVQNGNAVVECNVTVLH
Y</u>

Figure 101: Amino Acid sequence of 334. The conserved plant disease resistance response protein family domain is underlined.

MAGKNYSTATIAV<u>AVVLLFVCLHIAAVQAKVKLGNEKISHLHFYFHDLLVGKNVTAVQVASAP
TTNNYFTQFGMVRVMDDWLTEGPEGTSKMLGRAQGIYVSACQEKFQLLMATTFVFESGRY
NGSTLAMVGKNAVLEQVREMPIVGGSGFFRFARGYALAHTHSIDFKTGNAVVEYNVTVLH</u>Y

Figure 102: Amino Acid sequence of 335. The conserved Plant disease resistance response protein domain is underlined.

MAS<u>RCLFATLATATLVMAAAGEGVLNMAFYMHDHLNRNKDQTAFPVAGVNGSSSEASKFG
TLVVISDMVTKRPQITEYDTENILGRAQGTYVNTNPVTGLDFLMVFSLIFQNAEYNGSTLEIQG
TERFDQPHREYAVVGGTGKLRFARGYAVGTTVSTSGENAVLKINATFCTV</u>

Figure 103: Amino Acid sequence of 336. The conserved Plant disease resistance response protein domain is underlined.

MASGILFPVMAIIVIVSLQPAAGESEMNM<u>VFYLHDNLSGTNVTSFPVAGLNGSSSDAGKFGTL
VVTSDVKTKGPNSGSDNIAGRAQGTYVNTNMVNGLDFSMVFTLIFEDMEYGGSTLVIRGTDR
FDQPQCEYALVGGTGKFRFARGYAVVTTESVSAPNAVLKFNTTFLIPS</u>

Figure 104: Amino Acid sequence of 337. The conserved plant disease resistance response protein family domain is underlined.

MAGFKFLFP<u>AMAVTILVVFLKKAAAAAIEGEMNMVFYMHDNVKGNNVTAIPVAGTNGSSSPP
GHFGTVVVISDVITKFPDVAESESQNIVGRAQGMYINTNLDTRRDFLMVFTVIFNNMEYNGST
LEVQGTDRFDQTQREYAVIGGTGKFRFARGYAVVTTESLSGQNSVLKFNTTLSTL</u>

Figure 105: Amino Acid sequence of 338. The conserved plant disease resistance response protein family domain is underlined.

MAIKSGRALHLSFVWLVL<u>STALLQTSDVYSWKKKPLRKPYRNLVLYFHDVIYDGTNADNATS
TLVGAPHWANLTHLTAKDHQFGDLAVFDDPITLDNNFHSPPVGRAQGFYFYDMKNTFSAWL
GFTFVLNSTDHRGTITFAGADPILTKYRDISVVGGTGDFLMARGIATISTDAYEGDVYFRLCVN
ISL</u>YE

Figure 106: Amino Acid sequence of 339. The conserved Plant disease resistance response protein domain is underlined.

MGSGVL<u>FSAVAKTTLVLVFVQAAAGISETNMVLYMHDNLTGRNVTSFPVAGLNGSSSDPGK
FGTVVIMSDPITKQPEVTDSDGNNYLGRAQGAYINTNPHTGMEFLMVFAITFESMEYNGSTL
QIQGIERFDQPQREYFVVGGTGQFRYARGYVVCTMEYVSGENAVLRLNTTFRTD</u>

Figure 107: Amino Acid sequence of 340. The conserved plant disease resistance response protein family domain is underlined.

MPVKPSSRELVHLC<u>ILWLLVSTVLLQVTDGFVWKKREYEKPNWNKVFYFHDVLYNGNNAEN
ATSAIVAAPQGANLTSLTDNNHFGDLVVFDDPITLDNDMHSPPVGRAQGFYFYDMKNTFSA
WLGFTFVLNSTEHRGTITFAGADPILTKYRDISVVGGTGDFLMARGIATISTDAYEGDVYFRLR
VNTTL</u>YECYNCLLSASASHDNQ

Figure 108: Amino Acid sequence of 341. The conserved expansin/Lol pI family domain is underlined.

MKIFNNPLLFAVWALSMVSAALSCDRCLRKSKVASFARANINGACGYGNSATSLTARGGLV
MASASAKIYRDGVGCGACYQIRCTDPGVCTKSGVKVLVTDFTKSTQTDFVLSARSFSKLAVA
SKAAQFLKMGTVDIDYKRIPCDYGSQN<u>MTVKVDKSSKYPDYLAVQFLYQGGQTDITAVDIDR
VGSSGWQYMTHKNGAIWGIQNPPIGSLSFRLLVTGGYDGSWVWPTRNLLP</u>AIWRPGSVYD
SGVQITEIAQEGCSPCETGNWTDTRTP

Figure 109: Amino Acid sequence of 342. The conserved expansin domains are underlined and the Expansin/Lol pI family domain is in bold.

MAFLWLVSLGLLSMLRAAHGSGWTSAHATFYGGGDATGTMGGACGYGNLYSQ<u>GYGTNTA
ALSTALFNNGFSCGACYEIQCNDDLQWCLPGSIVVTATNFCPPNNALPNDN</u>GGWCNPPLEH
FDLSEPVFQHIAKFRAGIVPVQYRRVPCQRKG<u>GIRFTINGHSYFNLVLITNVGGAGDVEAVSV
KGAKTGWQPMSRNWGQNWQSNSYLDGQSLSFKVTTSDGKTVTSYNVASSNWQFGQTFA
GEQMN</u>

Figure 110: Amino Acid sequence of 343. The conserved expansin/Lol pI family domain is underlined.

MRRTVGLQWPLVPNVCVNVTAFCFVLLLLFSCKEAALGLEHT<u>ELNRDDLEWRPATATWYGS
PDGDGSDGGACGYGGLVDQKPLRARVGAVSPVLFKGGEGCGACYKVKCMEKGLCSEKPV
TVVITDECPGGYCAFGRTHFDLSGAAFGRMATNGKTPALLNTGELPVLYRRTLCEYPGKNIT</u>
FHVTEGSTAYWFSILIEYEDGDGDVGAMHLKQADSDAWMEMNHVWGANWCLLGGTPLKAP
FSVRVTTLTSKRTLSARNVIPDHWYPNATYKARLNFED

Figure 111: Amino Acid sequence of 344. The conserved expansin domains are underlined and the Expansin/Lol pI family domain is in bold.

MGALGFLVVGLLLVTTRATMASSWISAHATFYGGSDASGTMSGACGYGNLYSQ<u>GYGANTA
ALSTALFNNGLSCGACFQVMCNDDPQWCLRGSVVVTATNFCPP</u>**GGWCNPPLRHFDLSRPV
FLKIAKYKAGVVPILYRRVPCHKK**<u>GGIRFTINGHSYFNLVLISNVGGAGDVHGVWIKGSRTGW
QPMSRNWG</u>QNWQSNSYLNGQSLSFKVTTS<u>DGRSVTSYNVASVNWQFGQTFSGAQFH</u>

Figure 112: Amino Acid sequence of 345. The conserved expansin domains are underlined and the Expansin/Lol pI family domain is in bold.

MGFLAFIGLFVFNFLSMARFAHGWTNAHATFYGGGDASGTMGGACGYGNLYSQ<u>GYGTSTA
ALSTALFNNGLSCGACFAIRCNDDPQWCLPGAIVVTATNFCPPNNALPNNA</u>**GGWCNPPLQH
FDLSEPVFQHIAKFRAGIVPVMYQRVPCHRS**<u>GGIRFTVNGHSYFNLVLITNVGGAGDVHAVSI
KGSRTGWQPMSRNWG</u>QNWQSNSYLNGQSLSFKVTTS<u>DGRTVTSYNAAPSNWQFGQTFA
GAQIR</u>

Figure 113: Amino Acid sequence of 346. The conserved expansin/Lol pI family domain is underlined.

MATRTPNFFLFCSLGFMLIVTVPSPVLSCSSCVYQSKLAYYAYSGAVNVGACGYGSFAAKLY
GGNVGAASSDLYRNGVGCSACYQIRCTDPKLCNKSGTTIVVADFTQNNQTYFVVSRSTFSS
LAIADKGSQLIKGGIIDIEYKRVPCQYKDQNL<u>VVRVDGSSQYPHYLAVQFLYQGGQTDIVSVD
VAQVGTSGWHYMTRNHGAVWEIQKPPGGALQFRFVVTSGYDGKWLWAKKAVLP</u>SDWKSE
GLYDSGIQISDVALENCNPCNENNSGWADSSWIYV

Figure 114: Amino Acid sequence of 347. The conserved expansin domains are underlined and the Expansin/Lol pI family domain is in bold.

MATVKLATIFGLWWIASTAYALDYGWQSAHATFYGGSDASGTMGGACGYGNLYSQ<u>GYGTN
TAALSTALFNNGATCGACYQMKCNQQSDPQWCLPGTVTVTATNLCPPNSALPNDN</u>**GGWC
NPPLQHFDMAQPAFQQIAIYRSGIVPIMFRRVPCVRKGGVRFAINGHSY**<u>FNLVLITNVGGAG
DVEAVSIKGSNTGWQAMSRNWG</u>QNWQSNSYLNGQTLSFQVTTS<u>DGRTITSYNVASANWQ
FGQTFEGLQF</u>

Figure 115: Amino Acid sequence of 348. The conserved expansin domain is underlined and the Expansin/Lol pI domain is in bold.

MAPVKLATIFGLLWIVGTAYALDYGWQSAHATFYGGSDASGTMGGACGYGNLYSQ<u>GYGTN
TAALSTALFNNGATCGACYQMKCNQQSDPQWCLPGTVTVTATNLCPPNCWNVSNCRLR</u>
GQRRTWATMDSNSLPARISSQRPPRNHRSKPQNQPVSYRTTLQRKVVSVQRAPMQLGAD
NCPPSDAGMTSATDTHRKVSLG

Figure 116: Amino Acid sequence of 349. The conserved expansin domains are underlined and the Expansin/Lol pI family domain is in bold.

MNSGRSLHSDHLFGCKMAPVKLVTMFSFLWVAGAAYALDSGWQSAHATFYGGSDASGTM
GGACGYGNLYSQ<u>GYGTNTAALSTALFN</u>NGATCGACYQMKCNHHSDPQWCLPGTVTVTAT
NLCPPNSALPNDN<u>GGWCNPPLQHFDMAQPAF</u>QHIAIYRSGIVPIIFRRVPCVRK<u>GGVRFTING</u>
<u>HSYFNLVLITNVGGAGDVEAVSIKGSNTGWQAMSRNWGQNWQSNSYLNGQALSFQVTTS</u>
DGRTITSYNVAPANWQFGQTFEGLQF

Figure 117: Amino Acid sequence of 350. The conserved expansin domains are underlined and the Expansin/Lol pI family domain is in bold.

MAPLKLATMFSFLWIAGTAYAQDSGWQSAHATFYGGSDASGTMGGACGYGNLYSQ<u>GYGT</u>
<u>NTAALSTALFN</u>NGATCGACYEMKCNDQSDSQWCLPGTVTVTATNLCPPNSALPNDN<u>GGWC</u>
<u>NPPLQHFDMAQPAF</u>QQIAIYRSGIVPIMFRRIPCVRE<u>GGVRFTINGHSYFNLVLITNVGGAGD</u>
<u>VEAVSIKGSNTGWQTMSRNWGQNWQSNSYLNGQTLSFQVTTS</u>DGRIITSYNVAPANWQF
GHTFEGLQF

Figure 118: Amino Acid sequence of 351. The conserved expansin domains are underlined and the Expansin/Lol pI family domain is in bold.

MAPLKLATMFSFLWIAGTAYAQDSGWQSAHATFYGGSDASGTMGGACGYGNLYSQ<u>GYGT</u>
<u>NTAALSTALFN</u>NGATCGACYEMKCNDQSDSQWCLPGTVTVTATNLCPPNSALPNDN<u>GGWC</u>
<u>NPPLQHFDMAQPAF</u>QQIAIYRSGIVPIMFRRIPCVREGG<u>VRFTINGHSYFNLVLITNVGGAGD</u>
<u>VEAVSIKGSNTGWQTMSRNWGQNWQSNSYLNGQTLSFQVSTS</u>DGRIITSYNVAPANWQF
GQTFEGVQF

Figure 119: Amino Acid sequence of 352. The conserved expansin/Lol pI family domain is underlined.

MKRFRCMSPCKFSAWLVIGAVSVFLCVKASWALEEEELEWHPATATWYGSPDGDGSDGGA
CGYGNLVDVKPYRKRVGAVSPVLFKGGEGCGACYKVKCTDERMCAKRAVTFVVTDECPGG
PCAFGKTHFDLSGSAFGRMAIADKTTTILNSGEIPVLYRRTLCEFPRKN<u>VTFHVNEGSTAYWF</u>
<u>SILIEYEDGDGDVGAVHLREADSDEWMAMQHSWGANWCLLGGPMKAPFSLRVTTLSSNRT</u>
<u>LSARNIIPQNWYPTASYRSRLNFDR</u>

Figure 120: Amino Acid sequence of 353. The conserved expansin/Lol pI family domain is underlined.

MKRFRCMSPCKFSAWLVIGAVSVFLCVKASWALEEEELEWHPATATWYGSPDGDGSDGGA
CGYGNLVDVKPYRKRVGAVSPVLFKGGEGCGACYKVKCTDERMCAKRAVTFVVTDECPGG
PCAFGKTHFDLSGSAFGRMAIADKTTTILNSGEIPVLYRRTLCEFPRKN<u>VTFHVNEGSTAYWF</u>
<u>SILIEYEDGDGDVGAVHLREADSDEWMAMQHSWGANWCLLGGPMKAPFSLRVTTLSSNRT</u>
<u>LSARNIIPQNWYPTASYRSRLNFDR</u>

Figure 121: Amino Acid sequence of 354. The conserved expansin domain is underlined and the Expansin/Lol pI family domain is in bold.

MQTRRGSWVAYLLLLLLLNLGWWKQLIIMPTSAAYANDGWKYAFATFYSESDALGTMAGAC
GFGDLYRQGYGVNTAALSSVLYNGGQACGACFELRCVEDPLYCHPGTSIVVTATNFCPPNY
GLPGEDGGWCNPPRQHFVLPVTAFEKIAMWKIGTMNVQYRRVRCAKVGGMRFAINGKDF<u>F</u>
<u>LTVLISNVAGDGAVSGVKVKGSKTGWLSMGTNWGQNWHVNADYRGQALSFEVTTSDGKT</u>
VTSYNVAPSDWQFGHTYKGKQFS

Figure 122: Amino Acid sequence of 355. The conserved expansin domains are underlined and the Expansin/Lol pl family domain is in bold.

MLTSGFVLVAVAIIFANKFVSAHDYNGGWYYAHATFYGGADASGTMQGACGYGNLYSQ<u>GY
GTNTAALSTVLFNSGASCGSCFEIKCVDDPQWCLPGSPSIVVTATNFCPPNYALPNDN</u>**GGW
CNPPREHFDMAMPAFEQIGIWKAGIVPVQYRRVACVKEGGMRFTINGNYY**<u>FYLILVTNVGGD
GVVADVKVKGSNTGWLPLSRNWG</u>**QNWQCNTILKGQALSFRVTSSGGRTVTSYNVAPSH
WQFGQTFEGNQF**

Figure 123: Amino Acid sequence of 356. The conserved pollen allergen/expansin family C-terminal domain is underlined.

MATQTPVVFVLYCILGVNLLIVFPSLALGCTSCVHQSKLAYYAYPGAVDVGACGYGSFAETLY
GGNVGGSSRDLYRNGVACGACYQMRCTDSKLCTKSGTTIVVTDFTESSQTDFVVTRSTFSS
MALPDHGDQLLKAGIIDIEYKRVPCQYKNQN<u>MSVKVDKLSRYPNYLAVQFLYQGGQTDIVSV
DVEQVGSSEKHDLKRNYGAVWDIENPPEGALQFGFVIVSGYNGKRVWPTKSVLPSDWKVG
GVYDSGLQTNDVSLEKCSPCDHNDRGWGDSRIP</u>

Figure 124: Amino Acid sequence of 357. The conserved expansin domains are underlined and the Expansin/Lol pl family domain is in bold.

MISMTSMVRVKSVALVSMSTIIWLITRAHGYGDWESAHATFYGGSDASGTMGGACGYGNLN
SQGYGTNTAALSTALFNDGLSCGACYEMQCNDDAQWCLPGTVTVTATNFCPPNNALPNDN
GGWCNPPLQHFDMAEPAFQQIAKYKGGIVPILYRRVPCVRK<u>GGIRFTVNGHSYFNLVLITNV
GGPGDVHAVSIKGSRTGWQPMSRNWG</u>**QNWQSNSYLNGQSLSFQVTTSDGKTFVSYNAA
PSSWQFGQTFEGCQV**

Figure 125: Amino Acid sequence of 358. The conserved expansin domains are underlined and the Expansin/Lol pl family domain is in bold.

MRSMELVKSIALASLLTFIWLLTGAHGYGGWESAHATFYGGSDASGTMGGACGYGNLYSQ
GYGTNTAALSTALFNDGLSCGACYEMRCNDDPQWCLPGTVTVTATNFCPPNNALPNDN<u>GG
WCNPPLQHFDMAEPAFLKIAKYRGGIVPILYTRVPCLRK</u>**GGIRFTVNGHSYFNLVLITNVGGA
GDVHAVSIKGSRSGWQPMSRNWG**<u>QNWQSNSYLNGQSLSFQVTTSDGRTVVSNNVAPSN
WQFGQTFEGSQV</u>

Figure 126: Amino Acid sequence of 359. The conserved pollen allergen/expansin family C-terminal domain is underlined.

MAIGIIERQAASLVKGFVIALVFSISVAEGSGYTSSGWTSGHATFYGGSDASGTMGGACGYG
DLYSTGYGTKTAALSTALFNSGATCGACFQIQCDISKDPQWCLPGPKSITITATNFCPPNYAL
PSNDGGWCNPPLMHFDMAQPAWEQIAIYSGGIVPVQFRRVPCTPVGG<u>VRFTINGRSYFELV
LLSNVGGAGDISAVSIKGSNTGWQPMSRNWGVNWQSNSYLSGQSLSFQVTTSDGNSITFY
NVAPSNWQFGQTFATSQQFN</u>

Figure 127: Amino Acid sequence of 360. The conserved expansin domains are underlined and the Expansin/Lol pI family domain is in bold.

MQSPLKSRVRYVLMVLAIIFAQTLAAADDCDGDWNSAHATLYGGGDAAGIMAGACGYGNLY
SQGYGTNTAALSAILFDSGAACGACFEIKCVDDSQWCLPGSPSVVITATNFCPPNYALSNDN
<u>GGWCNPPREHFDMAMPAFE</u>QIAIWKAGIVPVQYRRVRCAKGGGIRFTIHGNRY<u>FYLILITNV
GGDGDVAEVMVKGSNTDWLPLTRNWGQNWQSNTNLQGQALSFQVSSSSGHTITSYNVA</u>
PSDWQFGQTFQGNQF

Figure 128: Amino Acid sequence of 361. The conserved Glycoside hydrolase, family 16, domain is underlined and the Carbohydrate-binding WSC domain is in bold.

MFSTKFFAAAAATFSLIRFSTAVYDPSSQRN<u>LAMYWGSGSDQLDLAHFCDETNVDIIPIGFINF
FPPQANGLVAETFGDQCWDGNYTGPGYDGTNNPNDNFLYEQCPNLQRDLYYCQQNTNKKI
LLSLGGAVGNYYLNGPSDGEYLAEFLWGAYGPYNESWTGVRPLDRGYYNTNLTEHIDFDGF
DFDIEQTTPDQQAGYIACIKRLRQLFIEHKAVNPCSKDYIISGAPQCPLDEPYMSTAIAGAQFD
VLWIQFYNNGANGCTARNYTDSKALGKTSGFNYDSWVTKVNGGASAGAKLYIGLLAGQAAS
EFSPNDYIDGPAIQTLVSQYHSHPQFGGIMLYEATVAENNAQFYNTVKGILNDTALAGTVTSS
AKVCSSTTSTSSKTSSTSTSTTSTSSKVTTTSSSTSSKASTTSSSSSTSSSSSTSSTSSSKTS
SSSSSSSSTKTSTSSSVSSTSTTSSSSSSSSSSSLSSSSSSSSTSAYPTTSSSSVISSTTSAS
STSSSSSSSSEISSSTSVSSTSSETPTSTPTPTTVPSVG</u>**SCTYLGCYTEATTTRALSGAVYDN
YTLMSVEICAGFCTGFTYFGVEYGGECYCGNEFGEGSVVSPPIDCSMTCAGTPTELCGAGD
RLDVYSCAGSATTTSSSVSGSSTSSIESSTSSSVSISSSSSVVSTSSSSVVSSTSSEVTPTTS**
STSSSVSSTSSLSSTSVYSDSSSSVTSTSTSSLSSSSSVSETLTSTSSSSIYSPTITSTAYTNS
SSAIVTPTSSLYTNSSSVITTSSSSSSSKSVCTRKTHTSSGSVSITSSYSVSGTATSISSYSVSS
GSSSSSASGIISTPSSSLSGSATSSAQGTATSASTTQYTTSTVYTTSVHTITSCAATVTNCPAR
STVLTTETIALYTTVCPVTATETGKGVPTTSSPVKPTSSGSGSGETTSYTTSTVYATSVYTITS
CAPTVTNCPARIGSVTTETIALYTTVCPVTATETGKVAPSSTPSASSPVLPGKGGKSSSSAAG
YPVSGTESVKHTTISSTT

Figure 129: Amino Acid sequence of 362. The conserved calreticulin domain is underlined, the Calreticulin family signatures 1 and 2 are in italics and the Calreticulin family repeated motif signatures are in bold.

MAMAGSTGRRQQQLLLLALALSSLAAIASAA<u>VLFEERFEDGWETRWVKSDWKKDENMAGE
WNYTSGKWNGDSDDKGIQTSEDYRFYAISAEYPEFSNKDKTLVFQFSV*KHEQKLDCGGGY
MKLLS*GDVDQKKFGGDTPYS*IMFGPDICG*YSTKKVHAILTYNGTNQLDQKGCSLTDQLTHVY
TFVLRPDATYTILIDNVEKQTGSLYSDWDLLPPKQIKDPEAKKPEDWDDKEYIPDPEDKKPEG
YDDIPKEIPDSDAKKPEDWDDEEDGEWTAPTIANPEYKGPWNPKKIKNPNYQGKWKAPMID
NPDFKDDPELYVFPKLKYVGIELWQVKSGTLFDNVLICDDPEYAKKVAEETWGKNKDAEKAA</u>
FDEAEKKREEEEAKDEPVDSDIEDEDDDADADDAEDDSDSVIKAEADESAESADSKDEVKD
EL

Figure 130: Amino Acid sequence of 363. The conserved calreticulin domain is underlined, the Calreticulin family signatures 1 and 2 are in italics and the Calreticulin family repeated motif signatures are in bold.

MMEGRRIRLLARALTVLLLSFQICASD<u>VIFHESFDESFEGRWVVSEKEEYQGVVWKHSKSEGH
DDYGLLVSEKARKYAIVKELDDVVSLKDGTVVLQYEV*RLQDGLECGGAYLKYL*RPQDAGWK
VKEFDNESPYTIMFGPDKCGATNKVHFIFKHKNPKTGEYVEHHLKHPASVPYDKLSHVYTAV
LKPDNELRILIDGEEKKKANFLSAEDFEPALIPPKTIPDPDDKKPEDWDERAKIPDSDAVKPDD
WDEDAPMEIVDEDAVKPEGWLDDEPEEIDDPEATKPEDWDDEEDGEWEAPKIDNPKCETA
PGCGEWKRPTKSNPAYKGKWHAPLIDNPNYKGIWKPQEIPNPDYFELERPNFEPIAAIGIEIW
TMQDGILFDNVLIASDEKVAESYRETAWKPKFEVEKEKQKEEDKATGSDGLSAIHKKVFDVL
YKVADVSFLEPYKPKILELIEKAEEKPNIAIGVLGSIVVVILTVFFKILFGGKKPVANVPEPRREA
AAETSNNQGSQGDKEDEDEKEDAGDAAAAAAPRKRPNRREI</u>

Figure 131: Amino Acid sequence of 364. The conserved calreticulin domain is underlined,The Calreticulin family signatures 1 and 2 are in italics and the Calreticulin family repeated motif signatures are in bold.

MEGSRIPRLVPALALVLISFAFLQIRASD<u>VIFYDSFDQPFVGRWVVSVKDDYTGEWKHSKSEG
HDDYGLLVSEKARKYAIVKELDEIVSLKDGTIALQYEV*RLQNGLECGGAYLKYL*RPQDAGWK
VKEFDNDSPYT*IMFGPDKC*GSTNKVHFIFKHKNPKTGEYVEHHLKFPPSVPYDKLSHVYTAV
LKPDNELRILIDGEEKKKANFLSAEDFEPPLIPPKTIPDPDDKKPEDWDEQEKIPDPDAVKPD
DWDEDAPMEIVDEDAVKPEGWLDDEPEEIDDPEATKPEDWDDEEDGEWEAPKIDNPKCEL
APGCGEWKRPMKRNPAYKGKWHAPLIDNPNYKGIWKPQEIPNPDYFELERPQFDPIAAIGIEI
WTMQDGILFDNILIASDEKVAETYRETTWKPKFEVEKEKQKEEDKDSDSPGLSAVHKKAFDV
LYMIADVPFLDPYKPKILDLIEKAEKQPNITIGVLVSIVVIILTLFFKILFGGKKPAVNVPEPRSEA
APETSDGPGSSGDKEDEDEDEDEDEKEETAAAPRRRSIRREA</u>

Figure 132: Amino Acid sequence of 365. The conserved calreticulin domain is underlined.

MKALLFLSFVLFVAVATAT<u>VHFQEEFDAGWEKRWVYSTADDASGSAGKFTATPGQYYGDA
QKDSGVQTSTDARFYKASAQFPKFSNKDKPLVLQYSVKNEQELDCGGAYLKLSPPGVDQKS
LTGETPYNIMFGPDVCGYSTRRVHFIFNYKGTNHLIKKTVAPSSDKLTHLYTAIINPDQTYEIRI
DNEKKESGKLVDDWDFLPPKEINDPSISKPADWVEEKEIPDPEDKKPEGYDDIPKEIPDPDAK
KPEDWDSELDGEWEPPTIPNPEYKGEWHPKLIPNPAYKGPWVHPQIPNPDYHYDDSIYAFE
HEFVAFEIWQVKSGTIFDHILVTDSLEEAEAFATGHFAAQQKAEKAMYDKQEEEKQEKEKAE
REAEKQKLEEEGKKEDDDEDEDEEEEEDEGKGHSHDEL</u>

Figure 133: Amino Acid sequence of 366. The conserved calreticulin domain is underlined,The Calreticulin family signatures 1 and 2 are in bold.

MAGTERRQQLLFLLPTSPLCLALLLLLSSLARLALSE<u>VIFEERFLDGWKRRWVVSDWKKSEG
KAGTFKYTAGKWPGDPDDKGIQTIKDAAHSAISAKLPEFSNKNRTLVLQYSIKFEQEIECGGG
YIKLLSGFVNQKKFGGDTPYSLMFGPDICGTQTKKLHVILSYQGQNYPIKKELECETGKLTHF
YTFILRPDATYSILVDNRERDSGSMYTDWDILPPRRIKDVNAKKPADWDDREYIEDPNEVKPE
GYDSIPSEIPDPKAKEPDNWDEEADGVWKPPKVPNPAFKGPWKRKKIKNPNYKGKWKIPWI
NNPEFEDDPDLYVMKPIQYVGIEVWQVKAGAIFDNVLICDDPEYAKQVVEEVFANREAEKEA
FEEAEKVRKAQEEEEARRAREEGERRRRERGYDRRYRDRYRDKYRRHDRRDYMDDYHDE
L</u>

Figure 134: Amino Acid sequence of 367. The conserved sucrose synthase domain is underlined. The conserved group 1 glycosyl transferase domain is in bold MAAPKLGRIPSIRDRVEDTLAAHRNELVSLLSRYVAQGKGILQPHHLLDELENIISEDEGKSSL
SDGPFSEVLKSAQEAIVLPPFVAIAVRPRPGVWEYVRVNVHELSVEQLTVSEYLGFKEELVD
GKSEDSFVLELDFEPFNASFPRPNRSSSIGNGVQFLNRHLSSIMFRNKDCLEPLLNFLRAHKY
KGHTLMLNDRIPSISRLQSALAKAEEYLSKLPTDTPYSEFEYMLQGLGFERGWGDTAERVLE
MIHLLLDILQAPDPSTLETFLGRIPMVFNVVILSPHGYFGQANVLGLPDTGGQVVYILDQVRAL
ENEMLLRIQKQGLDIAPKILIVTRLIPDSKGTTCNQRLERVSGTEHSHILRVPFRSDQGILRKWI
SRFDVWPYLETFALDAAHEITAELQGFPDFIIGNYSDGNLVASLLAYKMGVTQCTIAHALEKTK
YPDSDIYWKKFDEKYHFSCQFTADLLAMNNADFIITSTYQEIAGTKNTVGQYESHTAFTLPGL
YRVVHGIDVFDPKFNIVSPGADMCIYFPYSEKQKRLTALHGSIEKLLYDPEQNDEHIGSLSDR
SKPMIFSMARLDKVKNMTGLVECYAKNSKLRELANLVVVAGYIDVKKSKDREEIAEIEKMH
ELMKEYNLDGQFRWMAAQTNRARNGELYRYIADTKGVFVQPAFYEAFGLTVVEAMTCGL
PTFATCHGGPAEIIEHGVSGYHIDPYHPDQAATLLADFFEQSKRDPNHWTKISAAGLQRIYE
RYTWKIYSERLMTLAGVYGFWKYVSKLERRETRRYLEMFYILKFRELVKTVPVAADEPH Figure 135: Amino Acid sequence of 368. The conserved sucrose synthase family domain is underlined and the group 1 glycosyl transferase domain is in bold.

MAAPKLGRIPSIRDRVEDTLAAHRNELVSLLSRYVAQGKGILQPHHLLDELENIISEDEGKSSL
SDGPFSEVLKSAQEAIVLPPFVAIAVRPRPGVWEYVRVNVHELSVEQLTVSEYLGFKEELVD
GKSEDSFVLELDFEPFNASFPRPNRSSSIGNGVQFLNRHLSSIMFRNKDCLEPLLNFLRAHKY
KGHTLMLNDRIPSISRLQSALAKAEEYLSKLPTDTPYSEFEYMLQGLGFERGWGDTAERVLE
MIHLLLDILQAPDPSTLETFLGRIPMVFNVVILSPHGYFGQANVLGLPDTGGQVVYILDQVRAL
ENEMLLRIQKQGLDIAPKILIVTRLIPDSKGTTCNQRLERVSGTEHSHILRVPFRSDQGILRKWI
SRFDVWPYLETFALDAAHEITAELQGFPDFIIGNYSDGNLVASLLAYKMGVTQCTIAHALEKTK
YPDSDIYWKKFDEKYHFSCQFTADLLAMNNADFIITSTYQEIAGTKNTVGQYESHTAFTLPGL
YRVVHGIDVFDPKFNIVSPGADMCIYFPYSEKQKRLTALHGSIEKLLYDPEQNDEHIGSLSDR
SKPMIFSMARLDKVKNMTGLVECYAKNSKLRELANLVVVAGYIDVKKSKDREEIAEIEKMH
ELMKEYNLDGQFRWMAAQTNRARNGELYRYIADTKGVFVQPAFYEAFGLTVVEAMTCGL
PTFATCHGGPAEIIEHGVSGYHIDPYHPDQAATLLADFFEQSKRDPNHWTKISAAGLQRIYE
RYTWKIYSERLMTLAGVYGFWKYVSKLERRETRRYLEMFYILKFRELVKTVPVAADEPH

Figure 136: Amino Acid sequence of 369. The conserved sucrose synthase domain is underlined. The conserved group 1 glycosyl transferase domain is in bold MAERLLTRVHSLRERLDETLLAHRNDILAFLTRIEAKGKGILQHHQLIAEFEAISEEHRKKLSEG
AFGEILRSSQEAIILPPWIALAVRPRPGVWEYIRVNIHALVVEELQVTEFLHFKEELVNGNLNG
NFVLELDFEPFTAQFPRPTLSKSIGNGVEFLNRHLSAKLFHDKESLHPLLEFLQVHCYKGKNM
MVNTRIQNVFSLQHVLRKAEEYLSALKPETPYSQFEHKFQEIGLERGWGDTAERVLEMIRLLL
DLLEAPDPCTLENFLGRIPMVFNVVIMSPHGYFAQDDVLGYPDTGGQVVYILDQVRALESEM
LHRIKQQGLDITPRILIVTRLLPDAVGTTCNQRLEKVFGTEYSHILRVPFRTEKGMVRKWISRF
EVVWPYLETYTEDVANEIAGELQGKPDLIIGNYSDGNIVASLLAHKLGVTQCTIAHALEKTKYPE
SDIYWKKFEEKYHFSCQFTADLIAMNHTDFIITSTFQEIAGSKDTVGQYESHTAFTLPGLYRVV
HGIDVFDPKFNIVSPGADMSIYFSYTEEKLRLKSFHAEIEELLFSDVENKEHLCVLKDRNKPIL
FTMARLDRVKNLTGLVEWYGKNTRLRELVNLVVVGGDRRKESKDLEEQAEMKKMYGLIET
YNLNGQFRWISSQMNRVRNGELYRYICDMRGAFVQPALYEAFGLTVVEAMTCGLPTFATC
KGGPAEIIVHGKSGFHIDPYHGDQAAETLANFFEKCKVDPSHWDKISQGAMQRIKDKYTWQ
IYSERLLNLTAVYGFWKHVSNLDRLESRRYLEMFYALKYRKLAESVPLAVE Figure 137: Amino Acid sequence of 370. The conserved sucrose synthase domain is underlined and the Glycosyl transferase, group 1, domain is in bold.

MDSSPALKTTEPVPDSMPEAPSQSRYHMKRCFAKYMEKGRRIMKFHHLMDELESAIDAKTE
RELVLGSDLGYILCYTQEALVVPPHMAFAVRRSPGNWEYVKVSSDSLSVEGMSAADYLKFK
AMIYDEEWAKDENALEVDFGALDFSVPHLTLSSSIGNGVDFISKYLSSKLSGTPDSAQPLVDF
LASINYQGENLMINETLDTAPKLQMALIVAEASLASVPKDTPFQDFEMRFKEWGLEKGWGDT
AEKVKDTIRWLSEVLQAPDPTNMEKFFSRLPMIFNVVIFSPHGYFGQSDVLGLPDTGGQVVYI
LDQVRALEEELLLRIKEQGINAKPQILVVTRLIPDARGTKCNQELEPIIGTKHSNILRVPFRTEK
GVLRQWVSRFDIYPYLERFTQDATIKILDQLEGKPDLIIGNYSDGNLVASLMASKLGTTQGTIA
HALEKTKYEHSDVKWKELDPKYHFSCQFIADTIAMNATDFIITSTFQEIAGSHDRPGQYESHA
AFTLPGLCRVVSGINVFDPKFNIAAPGADQSVYFPYSEKQKRLTQLNRAIEELLYSRVDNDEH
IGYLADKKKPIIFSMARLDTVKNITGLVEWYGKNARLRSLVNLVIVGGFFDSSKSKDREEMA
EIRKMHDLIAKYKLKDQIRWIAAQTDRYRNGELYRWIADTRGAFVQPALYEAFGLTVIEAMN
CGLPTIATNQGGPAEIIVDGVSGFHIDPNHGEESSNKIADFFEKCKVDNEYWNKISAGGLKRI
NECYTWKIYANKMLNMGCIYTFWRQLNKEQKQAKQRYIQMFYSLQLRNSMKTVPIKTDEPE
QAAPKPPPKVQPTMSTRRTQSRIHK

Figure 138: Amino Acid sequence of 371. The conserved sucrose synthase family domain is underlined and the group 1 glycosyl transferase domain is in bold.

MADRVLNRSHSPRERLDEALFADRNDCLVFLSRLKAKGKGILQRHQILAVFEAIPEESRARLL
DGAFGKVLKSTQEAIVSSPWVALAVRARPGVWEHIRVNVHALLLEHFQVDEYLHFKEALVDG
SLNPDSEPLTATFGRPTLSTSIGNGVECIRRSLSDKLFPDKESLHPLLEFLQVHSYKGKNMMV
NARVQNVSSLQPVLRQAEEYLNTLKPETPFPKFEHKLQEIGLEQGWGDTAEWVLDMIQDLL
DLLMVPNPGALEKFLGRIPMVFDVVIVSPHGYFAQDNVLGYPDTGGQVIYILDQVRALETEML
HRIKQQGLDITPRILIITRLLPDAVGTTCGQRLEKVFRTKHSRILRIPFRDKKGIVSEWISRFKV
WPYLERFAEDVAKELRGELQRNPDLIIGNYSDGNIVAYSLAKKLGVTQCTIAHALEKGKYPGS
DIYWKKFDNEYHLSCQFTADLLTMNYTDFIIASTSEEIAGSKDTVGQYESYTNSTLPGLYRVV
HGINVFDPKFNIVSPGADMSIYFPYTEQKRRLKSFHPEIKELLFSDVENKEHLCVLKDKNKPII
FTMARLDRVKNLTGLVEWYGKNPKLREVANLVVVGGDRRKDSKDLEEQSEMKTMYDLIE
KYKLNGQFRWISSQTNQVRNGELYRYICDTKGVFVQPAIYEAFGLTVVEAMTCGLPTFATC
NGGPAEIIVHGKSGYHIDPYHGDQAAELLVEFFEKCKVDKSHWDKISKGAMQRIEEKYTWKI
YSERLLNLTAVYGFWKHVTSLDRRESRRYLEMFHALVYRPLAQSVPPAVE

Figure 139: Amino Acid sequence of 372. The conserved Glycoside hydrolase, family 17, domain is underlined.

MAASFLSNPSSLSFLLLLLLLHASRLAFSQSFVGVNYGQVADNLPPPESTAKLLQSTTIGKVR
LYGADPAIIKALANTGIGIVIGAANGDIPSLAADPNAAGQWVGANILPFYPASKITLVTVGNEVF
MSNDENLMSQLLPAMQNMQRAITAAGLGGKVKVSSVHAMSLLSQSDPPSSGRFHPSFEAR
MRDVLQFQRENGSPLPINPYPFFAYQSDPRPETLAFCLFQPNAGRVDSGTGIKYMNMFDAQ
VDAVYSALKALGYKDIEIMVAETGWPYNGDSNEVGTSVENAKAYNGNLIAHLRSLVGTPLMP
GKSVDTYIFALYDEDLKPGPTSERSFGMYKPDLTMTYDIGLAKSSQTPASPKAPVTPTPVTPT
PKPTGPGWCVPKSGVSDAQLQASLDYACSNNIDCSPIQPGGACFDPNTIASHAAFAMNLYY
QTLGRNPWNCDFSQTATLTTNNPSYNGCVYPGGST

Figure 140: Amino Acid sequence of 373. The conserved glycoside hydrolase, family 16, domain is underlined.

MASSSSLLRALFLLLSLSDSATQILGL<u>EFGINYGQIADDLPSPSRVATLLGSLNVSRVKLYDAD
PNVLQAFSNSNVDFIIGIGNDNLQNMTILANAQDWIQQHVQPYIGQTQISCIVVGNEVLNSSN
NQWMPYLVPAMKTVYSALSNLGLNKQVAVTTAHSLNILATSYPPSAGSFWPNLAQYLQPLLN
FQAQINTPFLINAYPYFAYKGSPSEVSLNYVLFQPNEGLTDPVTNLHYDNMLYAQIDAVYSAIK
AMGHTDITVRISETGWPSKGDDDEAGATLENAHIYNENLLQRIEQKQGTPAKPSVPIDIYVFA
LFNENLKPGPTSERNYGLYYPDGTPVYSLGL</u>QGYLPELYSATGTRPGLYSATGTRVLPFSVV
LVSIMTFLMNI

Figure 141: Amino Acid sequence of 374. The conserved glycosyl hydrolases domain of family 17 is underlined.

MASSALPPSNLLLLLLLLLISGLACVAAMAAP<u>IGVNYGQIANNLPSPDHAVTLVKSIGATRVKLY
DADSRVLCAFAHTGVEFTVGLGNEFLVQMKDPKNALSWVKSNVQSFLPDTNITTIAVGNEVF
TSNDTSLRDLLMPAMKNVHDALASLGLDKQVTVTTAHSLAILETSYPPSTGRFRRDVASRVS
QVLDFQCQTGSSFLINAYPYFAYKANPKQVPLDFVLFQASQGITDPSTGLNYENMLFAQIDAV
HSALAAVGYANMTVHVSETGWPSRGDDDEVGATPENAKKYNGNLIKIVKQKKGTPMKPNSD
LNIYVFALFNENMKPGPMSERNYGLFKPDGTPSYTLS</u>SGGGGGGGGGTSNGTSSGGFGG
GGGGGGSASDGTPPAPIGYLSVSSGANELRSLGAACLMLALFLIKLVF

Figure 142: Amino Acid sequence of 375. The conserved glycosyl hydrolases domain of family 17 is underlined and the glycosyl hydrolases family 17 signature is in bold.

MAKSSPFAADSLSIPSMLLFALMVFTILHRTAAQ<u>TGVCYGMLGNNLPSAQEVVALYKQNNIPT
MRIYDPNPQALQALGGSNIELVLGLANPDLQSIASSQANASAWVQNNIKNHGNVRFKYVAVG
NEVKPSDSFAQFLVPAMRNIRTALAGAGLEQIKVSTSVDTGVLSESFPPSKGVFRSDYMPLL
GPIIGLLVETQAPLLVNVYPYFSYIGDPQGIRLDYALFTAPSVVVTDGALGYQNLFDASLDAVY
SALEKADGGSLKIVVSETGWPSAGGGEATTLDNARTYNTNLAKHVKGGTPRRPRGPIETYV
FAMFDENQKSPETEKYWGLFLPNKQPKYSIDLN</u>

Figure 143: Amino Acid sequence of 376. The conserved glycosyl hydrolases domain of family 17 is underlined.

MANPHLPPLSLLLLLLLLGSAHGVSA<u>VGVNYGTIGNNLLPPKKVAQLLQSTLIDRVKIYDSNPD
ILDAFSNTGIDLVVAVENPLVANLSKDPSAAAEWLASRVAPFLPATSVVSVAVGNEYLTSGDD
KLEPNDVVQAMQNLHAALVARGLDRKIKVSTPHSMAVLAASFPPSSSTFAMTLLPTMTSIVQ
FLADTGAPFMINAYPYFAYRDNPSSVDLEYALLGNKTTVRDPKGYVYTNMLDAQIDAVRSAIG
ALGFGNRSIEITVSESGWPSKGEDGDKAATPENARTYNTRLIERAQANRGTPMRKEERVEIF
VFALFNENKKEGGVAERNFGLFAGDGSKAYDVDL</u>SCQFCSGGVSGFGEKAAGSSGVALRG
PSVWCVAKPHAEEGVLQAVVDFCCGAGGVDCREVYEGGDCYAPEKVHAHASYAMNAYYQ
MHGRNYWNCDFKGTGLVTFGDPSYGRCRYSQQ

Figure 144: Amino Acid sequence of 377. The conserved glycosyl hydrolases domain of family 17 is underlined.

MQMGLLHLLVFSSLLLALCSAEIL<u>SKVGVNYGQLGNNLPSPTRSVWLIKHQLKAQRVKIYDAN
PSILRALKHTGIQVSVMVPNELINAIAVNQTLADSWVGSNVVPFHPATKIRYLLVGNEILSSAD
NTTWFNLVPAMRKVKKALKRHKVHHKVKVGTPLAMDVLATSYPPSSGSFRPDVSDRVMKP
MLQFLNRTKSFFFIDVYPYFAWSSDPKTIDLNYALFESKNVTVKDPGTGLVYTNLFDQMVDA
VTFAMKKLGYPNIPIWIAETGWPNAGDYDQIGANIYNAATYNRNVVKKLSARPAIGTPARPG
WVLPSFMFALYNENQKTGPGTERHFGLLYPNDSFVYDIDLSGETPDTEYGKLPAPTNNEPYE
GKIWCVVAKRANRSALASALSYACSQGNATCGPIQPGKACHRKGSLVRQASYAFSSYWAQ
FRKTGGSCYFNGLATQTIEDPSYGSCEFPAVTL</u>

Figure 145: Amino Acid sequence of 378. The conserved glycoside hydrolase, family 17, domain is underlined.

MMGERGLGRILLLLLPFLPIALGAF<u>VGINIGTDVTNLPEASDIVAVLKSNEITHVRLYNADAHML
KALANSGINVMVGVTNEEVLGIGEYPATAAAWINKNVAAYLPATNITAIAVGSEVLTAIPHAAP
VLVPAMNNLHKALVASNLNFVVKVSTPQSTDVIPKPFPPSAAAFNSSWNSTLYQLLQFLKNT
NSSYMLNAYPYYGYTQGNGIFPLDYALFRSLPSVKQIVDPNTLFHYSSMFDAMVDATYYSIEA
MNFSGIPVMVTETGWPWFGGSNEPDATAENAQTFNNNLIKRVLNGSGPPSQSDVPINTYIYE
LFNEDKRPGPVSEKNWGVFFTNGTSVYPLSLGTSGRITGNSSGIFCVAKQDADSDKLQDGL
NWACGQGHANCAAIQEGQPCYSPNTVANHASYAYNDYYQKMQGVGGTCDFQGTAMTTTV
DPSYGSCKFTGSSNSSSTVTTPVASAPFSPIGGGSPTSAVLASKLKYVICTISVVLTLL</u>

Figure 146: Amino Acid sequence of 380. The conserved glycosyl hydrolases domain of family 17 is underlined and the glycosyl hydrolases family 17 signature is in bold.

MAISKLAPLLFLALVFLSIAEPGEPSLFADIKQGQDPDKEPY<u>VGVNVGTDVSHLLSPPNLVSFL
QVQKITHVRVYDADPDLLKALAKTKIRVIIGVPNNQLLAIGSSNATAASWVGRNVVAYYPETSII
GIAVGDEVLTTVPSSAPLLVPAIESLYSALVAANLHTQIKVSTPHAASIILDSFPPSQAYFNQSL
VSVMLPLLQFLSRTGSPLMMNLYPYYVFMQNKGVVPLDNALFKPLTPAKEMVDPNTLLHYTN
VLDAMIDATYVSMKNLNVTDVVVLVSESGWPSKGDSKEPYATVDNADTYNSNLIKHVLDRT
GTPLHPELTSSVYIYELFNEDLRSPPMSEANWGLFYGNSTAVYLLHVSGSGGFLANDTTNQT
YCIAMDNVDSRTLQTALDWACGQGQANCSEIQPGEDCYQPSNVKNHASYAFDSYYQKEGK
AAGSCDFKGVAMITTTDPSHGSCIFPGSKKVSNATKQVVNSTVSSGATESSRFFIFSSNRRT</u>
AIDKALGSVFSVLFSFFLAVALWTPI

Figure 147: Amino Acid sequence of 381. The conserved Glycoside hydrolase, family 17, domain is underlined MEHLPLAFFFLLLSVLSLADGGS<u>IGVNYGRVADNLPPATKVVQLLKSQGVQKVKIYDADPAVL
HAFAGTGIRLTVDLPNEKLFAAARSLSFSLDWVQQNVADYPTTQIEAIAVGNEVFVDTHNTTR
FLVPAMKNIHTALVKHNLHNAIKISSPIALSALQASYPSSAGSFRPELIEPVFKPMLEFLRQTGS
YLMVNAYPFFAYESNSDVISLDYALFRENPGVVDAGNGLRYFNLFDAQIDAVFAAMSALKYD
DIKMVVTETGWPSKGDENEVGASKDNAAAYNGNLVRRILTGGGTPLRRQADLTVYLFALFN
ENKKPGPSSEQNYGLFYPNQDKVYDVPLTVEGLKNYHDTGKSAPAGGGQRGVAAPVKGGR
GGVSKSSSANTWCVAKGEAGKEKLQAALDFACGEGGADCRPIQRGSTCYDPNTLEAHASY
AFNSYYQMKGRAFWTCDFGGAASIVSQPPKYGKCDFPTGY</u>

Figure 148: Amino Acid sequence of 382. The conserved glycoside hydrolase, family 17, domain is underlined.

MITEMSKIIPRMLSDSVFDIVFLLLSSSFFMQGARAG<u>IGVNYGTVADNLPPPAQVAHFLLESTTI
DRIRLFDADPDILKAFANTGIAVTVTVPNDLIPQLAKLSNAQDWVRTNVEPYVPATDIVRILVG
NEVLATANRLLLGNLVMSMRMLHAALANASLDGRIKVSTPHSLGILSSSSPPSSGKFRLGYD
VHILRPLLNFLRETGSPFLVNPYPFFGFSKDTLDYALFRPNAGVMDENSKLVYTNMLDGQLD
AVYSAMKVLGFTDIEVVIAETGWPSLCDSTQVGVDAKTAAEYNSNLIRHVSSGAGTPLMPKR
TFETYIFALFNENLKPGPTCERNFGLFRPDMTPVYDAGILRPTARSSVPIDPIPAPSSMTPPTS
PASMSPPKGTQWCLPKTGADPDALQRNIDYVCGLGLECRPIEEGGACFLPNTVRAHAAYAM
NAYYQAMGGNNYDCDFKGTGAVTAIDPSYGKCTYHG</u>

Figure 149: Amino Acid sequence of 383. The conserved family 17 glycoside hydrolase domain is underlined and the glycosyl hydrolases family 17 signature is in bold.

MANLFPLATAVFFLSVACPHLSRAAYT<u>IGVNYGTVADNLPPPSQVATFLKTKTAIDRVKLFDA
NPDILRAFAGTGIAVTVTVGNGDIISLSKLPAAQAWVSANILPFHPKTLINRIAVGNEILATSDKN
LIARLLPAMKALHSALQLVNVTNVQVTTPHSLGILSSSEPPSTGRFRRGYDRAIFAPILDFHRQ
TKSAFMVNPYPFFGFTAKTLNYALFKPNAGIFDAATGKNYTNMFDAQMDAVYSAMKKVGYE
DVEIVVGETGWPSVGDANQPDVNMANAVSYNGNLVRHVNAGKGTPLMPNRKFETYVFALF
NEDLKPSTSERNYGLFKPDLTPVYDVGILRNEPAGGPAPASPSPTAQPSPTAPPTSSGKKW
CVPRSDASDQALQANIDYVCSAQVDCKPIQTGGACFDPNTVRSHAAYAMNAYYQSMGQHD
YDCDFDKTGVVTAVDPSTSSSIPCF</u>

Figure 150: Amino Acid sequence of 384. The conserved Glycoside hydrolase, family 17, domain is underlined.

MLQPRTKVATFSLLLVLSSSFPAAEPA<u>IGVNWGTISFHRLRPSTVVDLLQQNKIQKVKLFDAD
PGALKALEGSGIEVMVGIPNEMLTVLGSSSVASDLWVRQNVSSFVGKGGVAIRYVAVGNEPF
LSSYAGQFQNYVMPALLNLQQSLAKANLAGYVKLVVPCNADAYEADLPSQGAFRPELTQIVT
QLVSFLNSNGSPFVVNIYPFLSLYGSTDFPQDYAFFGGTTHAVTDGANVYTNAFDGNFDTLV
AALTKLGYGQMPIVIGEVGWPTDGALNANLTAARAFNQGLINHVLSNRGTPLRPGVPPMDVY
LFSLLDEGAKSVLPGNFERHWGIFSFDGQAKYALNLGLGNRLLKDARNVQYLPSRWCVADP
SKDLSAVMNHMKLACSVADCTTLNYGGSCNGIGAKGNISYAFNSYYQLQMQNSQSCDFDG
LGMVTFLDPSVGECRFLVGVTESTSAAVETYWRGVIVWVLVMWSVWVFEV</u>

Figure 151: Amino Acid sequence of 385. The conserved family 17 glycoside hydrolase domain is underlined MAIPPLATLVLLVVLSQASCFANSQSF<u>IGVNYGQVADNLPQPSATAKLLQSTSIEKVRLYGTD
PAIIGVLANTGIGIVIGAANGDIPALANDPNFAKNWVNANVVPFYPSSKIILITVGNEVMTSGDH
NLMTQLLPAMQNMQNALNAVSLGGKIKVSSVHSMAVLKSSEPPSSGSFDPSDEMKGILGFN
NATGSPFAINPYPYFAYRSDPRPETLAFCLFQPNAGRLDTKTQIKYTNMFDAQVDAVRSALN
SFGYKNVEIVVAETGWPYKGDSNEVGPSIENAKAYNGNLIAHLRSLVGTPLMPGISVDTYLFA
LYDEDLKPGPTSERAFGLFKSDLSMNYDIGLSKSSQTPAAPKMPAAPSPNATVTPSPNATVT
PSPKPDKANWCIPKSGVSDAQLQANLDYACGQGIDCRPIQPGGACFEPNTLAAHAAYAMNL
YYQNSNRSPTNCDFSQSATFSSNNPSYNGCVYPSGKS</u>

Figure 152: Amino Acid sequence of 386. The conserved glycoside hydrolase, family 17, domain is underlined MAESISHYPFPTLGLIVLCFMTMFSIGSS<u>VGVNWGTQSNHQLPPEKVVKMLKENGIKKLKLFE
YDEKILGALAGSKIEVMLAVPNYMLEIMSVDPSFAASWVDTNVTSYRYTGGVNIKYIAVGNEP
FLQSYNHKYVRQVLPALRNIHEALHRARLSSKVKVTVPFNADVYYSPPPNEYPSSGDFRPEV
RDAAIEIIHFLYINDSPFTVNIYPFLSLYQNQNFPVDFAFFDGTTEPVKDGDRVYTNVFDANFDI
LVSALTKAGYSDMEIIVGEIGWPTDGDKFANIKNAQRFNQGLLKHALSGDGTPARKGVINVYL
FSLIDEDTKNIDPGNFERHWGLFEYDGKPKYELDLSGSEKDTRLVPVMGVSYMPRRWCILNP
ELNDLTDLGENIDYACKSSDCTALGYGSSCNNLSSQGNASYAFNRYYQMNDQRIMACDFQG
LAVVTENDPSTEGCQFPLMIASGDSMSWNQGLLHTSFRFYLWFLVFWVIL</u>

Figure 153: Amino Acid sequence of 387. The conserved Glycoside hydrolase, family 17, domain is underlined.

MEKFDLFKWVLCGSIVLFGVGCGRVDG<u>LGVNWGTLATRKLPPKTVVQMLKDNGIQKVKLFD
ADRKTMSALAGSGIEVMVAIPNDQLAVMGSYDRAQEWVKKNVTAYNFTGGVNVKYVAVGN
EPFLKSYNGSFVNTTLPALQNIQKALNEAGLGDTVKATVPLNADVYESPEDNPLPSAGTFRS
DISDVMTQIVKFMAENNAPFTVNIYPFLSLYGNNDFPNYAFFDGATPIVDKGIEYTNVFDANF
DTLVSALKAVGHGNMTIIIGEVGWPTEGDINANNGNAYRFYNGLFTKLGANRGTPLRPGYIEV
YLFGLIDEDAKSVAPGNFERHWGLFRYDGQPKFLIDLTGRGQNKLLIPAQNVEYQPQKWCTF
NAGAKDVSKLVDNINFACTYADCTTLGYGSSCNSLDANGNASYAFNAYFQTQNQDPDSCNF
QGLATVTTKNISQGSCNFTIQLVASSTSILRPLIVLTVISMAYTFLLQ</u>

Figure 154: Amino Acid sequence of 388. The conserved family 17 glycoside hydrolase domain is underlined and the glycosyl hydrolases family 17 signature is in bold.

MASLFPLTAAVVFLSVACPHLSRAAY<u>TIGINYGTIADNLPPPSKVATFLKTKTTIDRVKIFHASP
DILRAFAGTGIAVTVSVGNEDIVSLSKLPAAKSWVSANILPFYPKTLINRIAMGNEILATSDKTLI
ANLLPAMKALHSALQLANVTNVQVTTPNSLGILASSYPPSNGSFRSGFDRTIFAPILKFHRQT
NSSFMVNPYPFFAITPENVNSLLNYSLFKPIPSSTFDAATGKNYTNMFDAQMDAVYSAMKKV
GYEDVEIVVGETGWPSVGDPNQPGVSMANAESYNSNLVRHVNSGKGTPLMPNRKFETYIFA
LFNENKKPSTSERNYGLFKPDLTPVYDVGILRNSVNAVPLHLLG</u>

Figure 155: Amino Acid sequence of 389. The conserved Glycoside hydrolase, family 10, domain is underlined and the Carbohydrate-binding CenC-like domains are in bold MRRVCACFLTSPAKTPPKHGTQRVSKQTAGNQKSESASNNSEVMANSSGSQGTNIIQNHNF
SGGLHSWHPNCCESWVVSAESGDCYAMVTNRKECWQGLEQDITSRVTPGSTYSVSACVG
VSGSLQGSADVLATLRLEHQDSAATYKRIGITSVSKERWDKVEGSFSLSSMPNRVVFYLEG
PSSGIDLLIKSVVITCQSANGKERVDREHIAAGDENIILNPIFDDGLKNWAGRGCKIVLHDSM
ADGKIVPQSGKYFVSATERTQTWNGIQQEVTGRLQRKLAYEVTALVRIFGNNVSSTDVRITL
WTQTPDLREQYIGVANVQATDKDWTQMQGKFLLNGSPSKVIIYIEGPPAGTDILVNSLTVKH
AAKAAPSPPPVIQNPAFGVNIIGNSDLDNGTNEWFPLGNCTLSVRAGSPHILPSSARDSLGP
HEPLSGSYILVTNRTQTWMGPAQMITDKLKLFLTYQVSAWVRIGSGASGPQNINVALGVDN
QWVNGGQVEANDDRWHELSGSFRIEKQPSKVMVYIQGPAPGVDLMVAGVQIFPVDRQAR
FNHLKHLTDKLRKRDVVLKFSGADSSSLVGAT<u>VIVKQTQNSFPFGSCISRTNIDNEDFVDFFV
KNFNWTVFGNELKWYWTEPQQGNFNYRDADEMLDLCKSHGIETRGHCIFWEVESTVQAW
VQSLNNNDLMSAVQNRLNGLLSRYKGKFSHYDVNNEMLHGSFYQGRLGKDIRANMFKTAN
QLDPSATLFVNDYHVEDGCDTKSCPEGYIEHILGLQEQGAPVGGIGIQGHIDNPVGPIINSALD
KLGILGLPIWFTELDVSSVNEYVRADDLEVMLREAFAHPAVDGIMLWGFWELFMSRDNAHLV
NAEGDVNEAGKRYLALRKEWSSHAHGHVNEQGEYTFRGFHGTYDVLIVTSSKRTTKSIVVD
KGESPLVVPISL</u>

Figure 156: Amino Acid sequence of 390. The conserved glycoside hydrolase, family 10, domain is underlined.

MTMILPGFSRTAPIAGAMRTSPGFNMFLFLSLAFALLSLGSAISGQIMQTVFDDYYDSSATTQ
CLAEPGSLMYGGGVILNPEFIHGTSGWTVLGEGATEVRISHTNNRFMVARDRKRPTDSFSQ
KVQLEKGMFYAFSAWVQASQGSETVAVVFRTRDGKFVRGGSVVAKQGCWSLLKGGIAANS
SSPADVLFESKNTSTEIWVDNVALQSFSKKQWRTHQEESIEKVTRKRKSTVRFQITSANERG
LGVGGAN<u>VLIKQIKPGFPFGCGMNFHILESADYQNWFASRFRYATFTNAMKWYSTEKEQGQ
EDYSVADAMLKFVQDNNISIRGHNVFWDDPKYQPDWVRTLSPDDLRKAAEKRINSVVSRYA
GELIAWDVVNENLHFSFFEDNLGENASSMYYSMAYKLDPTPRMFLNEYNTIEYSGDEKVSP
GNYKKRFQEIFTYPGNEDIPAGIGVQGHFGAGQPNSAYMRSGLDILATTGLPIWLTEVSVAP
GANQQYLEEVLREAYSHPGVEGIIMFAGPAYAGFNSTALADMNFDNTPTGDVVDQLIQEWR
FKDLAARADDEGFFSTKLLHGEYEITITDPISNSSSTSRFQVTKDSFKIIYHFHM</u>

Figure 157: Amino Acid sequence of 391. The conserved Glycoside hydrolase, family 10, domain is underlined.

MKDASAFISFLVFFLLLCSPWIAASLDDPQYDHTAYTKCKEEPEKPLYNGGILEPHQLPQFAS
SSPALLLHNLTASTKYSFSSWVKIESSDSDSALVTASLRTNHETYDCIGTVAAKSGCWSFLKG
GFTLDLPSNSATLSFESSDGRYIAIAISSTSLQPFTDQQWRRNQQDMINKVRKRAVMIHVSNH
NGDRLQGVE<u>INVKQVYKDFPFGSAIAKTILGNEAYQNWFVERFNAAVFENELKWYATEPYPG
QINYTIADEMLEFIRANRIVTRGHNIFWEDPKYNPEWVQNLSGPQLESAVDTRIQSLMSRYRE
EFVHWDVSNEMLHFDFYERRLGPNATLHFFQTAHESDPLATLFMNEFNVLETCSDANSTVD
SYISRMRDLKRGGVSMDGIGLEGHFTVPNLPLMRAILDKLGTLRLPMWLTEVDISSTLSKESQ
ALHLEEVLREGFSHPSLNGIMLWTALHPNGCYQMCLTDADFRNLPAGDVADSL</u>LGEWRTKE
VNGKTNEHGSYSFEGFLGEYEVSVMHGDQTANSTFALSQGVETRHVTILL

Figure 158: Amino Acid sequence of 392. The conserved N and C terminal domains of family 3 of The Glycoside hydrolases are underlined.

MMTPAQNRAPKVSSVLLCLCCIHAFFSCAVRLVAGQTPKPVFACDVGNPSLAAFGFCNTS
WG<u>VEARVADLVQRLTLQEKVGFLVSGAGNVDRLGIPKYEWWSEALHGVSYVGPGTKFSSL
VPGATSFPQVILTAASFNATLFETIGKVVSTEARAMHNVGLAGLTFWSPNVNIFRDPRWGRG
QETPGEDPLLSSKYASGYVRGLQKSDDGNADRLKVAACCKHYTAYDVDNWKGVNRLTFNA
VVTQQDLDDTFQPPFKSCVLDGNVASVMCSYNQVNGKPTCADPDLLAGTIRGKWKLNGYIV
SDCDSVEVLYDKQHYTKTPEEAAAKAILAGLDLNCGSFLGQHTEAAVKGGLLNESAVDKAIS
NNFATLMRLGFFDGDPRKQLYGKLGPDDVCTPSNQELAREAARQG</u>I<u>VLLKNTAGSLPLSSTA
IKSLAVIGPNANVTKTMIGNYEGTPCKYVTPLQGLAAIVSTMYVAGCADVGCSTAQTDDAKKA
AASADATVLVMGADQSIEREDFDRVNLNLPGQQSLLVSEVANVSKGPVVLVIMSGGGMDVS
FAKDNAKITSILWVGYPGEAGGAAMADVIFGDHNPSGRLPMTWYPQSYVDAVPMTNMNMR
PDPATGYPGRTYRFYTGPTVYSFGDGLSYSSFSHGQVQVPQLVSVPLDEGHICHSSACESL
EAKSETCSNLVFDVHLNVKNVGRFSGSHTVFLFSSPPSVHRSPQKHLLGFEKVFLASQSEAQ
VQFKVDVCKDLSVVDELGGRKVALGTHVLHVGDLKHALSVQIGSSGLSLSPPRHF</u>

Figure 159: Amino Acid sequence of 393. The conserved N and C terminal domains of family 3 of The Glycoside hydrolases are underlined.

MMTPAQNRAPKVSSVLLCLCCIHAFFSCAVRLVAGQTPKPVFACDVDGNPSLAAFGFCNTS
WGVEARVADLVQRLTLQEKVGFLVSGAGNVDRLGIPKYEWWSEALHGVSYVGPGTKFSSL
VPGATSFPQVILTAASFNATLFETIGKVVSTEARAMHNVGLAGLTFWSPNVNIFRDPRWGRG
QETPGEDPLLSSKYAAGYVRGLQKSDDGNADRLKVAACCKHYTAYDVDNWKGVNRLTFNA
VVTQQDLDDTFQPPFKSCVLDGNVASVMCSYNQVNGKPTCADPDLLAGTIRGKWKLNGYIV
SDCDSVEVLYDKQHYTKTPEEAAAKAILAGLDLNCGSFLGQHTEAAVKGGLLNESAVDKAIS
NNFATLMRLGFFDGDPRKQLYGKLGPDDVCTPSNQELAREAARQGIVLLKNTAGSLPLSSTA
IKSLAVIGPNANVTKTMIGNYEGTPCKYVTPLQGLAAIVSTMYVAGCADVGCSTAQTDDAKKA
AASADATVLVMGADQSIEREDFDRVNLNLPGQQSLLVSEVANVSKGPVVLVIMSGGGMDVS
FAKDNAKITSILWVGYPGEAGGAAMADVIFGDHNPSGRLPMTWYPQSYVDAVPMTNMNMR
PDPATGYPGRTYRFYTGPTVYSFGDGLSYSSVSHGQVQAPQLVSVPLDEGHICHSSACESL
EAKSETCSNLVFDVHLNVKNVGRFSGSHTVFLFSSPPSVHRSPQKHLLGFEKVFLASQSEAQ
VQFKVDVCKDLSVVDELGGRKVALGTHVLHVGDLKHALSVQIGSSGLSLSPPRHF

Figure 160: Amino Acid sequence of 394. The conserved N-terminal and C-terminal domains of glycoside hydrolases family 3 are underlined.

MXGTALPAAAAGTATLLLLLLISGGIGRLAVGAREPFACDPKDERTRGFPFCQASSPVPERA
RDLVGRLTLQEKAKLLGNDAAAVPRLGIKGYEWWSEALHGVSNVGPGTRFGGDFPGATSFP
QVITTAASFNASLWEAIGQVVSDEARAMYNGGMGGLTYWSPNINILRDPRWGRGQETPGED
PVVVGQYAASYVRGLQGADGNGGGRLKVAACCKHFTAYDLDNWNGVDRYHFNARVSKQD
MEDTFSVPFRMCVMEGKVASVMCSYNQVNGIPTCADPNLLRKTVRGAWRLDGYVVSDCDS
VGVFYGNQHYTSTPQQAVADAIKAGLDLDCGPFLGKHTEEAVRGGLMNEADIDGALLNTLAV
QMRLGMFDGEPSAQPYGTLGPKDVCTPAHQELALEAARQGIVLLKNQGPALPLSPRRHRAV
AIIGPNSDVTVTMIGNYAGVACGYTTPLQGIGKYTKTIHQQGCADVACSDDKLFEGAIKAARG
ADATVLVMGLDQSIEAEFKDRDSLLLPGRQQELVSKVAMASKGPTVLVLMSGGPVDISFAKN
DPRVAAILWAGYPGQAGGTAIADILFGATNPGGKLPMTWYPQDYLASVPMTVMDMRPTRSN
LYPGRTYRFYGGPVVYPFGHGLSYTHFVHTLASAPSTVVVPLAGRRPANATMGPGKAVRVT
HARCARLSLRVQLDVQNAGARDGAHTVLVFSTPPEDGGARWAPPRSQLVGFQRVHVAAGA
RERVGINIHVCKSLSVVDGAGVRRIPMGEHRLQIGDVVHSVSLQAEPLRVI

Figure 161: Amino Acid sequence of 395. The conserved glycoside hydrolase, family 3, N-terminal domain is underlined, and the conserved glycoside hydrolase, family 3, C-terminal domain is in bold.

MRNRQVQILSLLITFASAATLLSTPAAAQPPPFSCDPSSPSTKSFPFCKASLPISKRAQDLVSR
LTLDEKISQLVSSTPAIPRLGVPAYEWWSESLHGVSNAGRGIHFDGTIKSATSFPQVILTAASF
DADLWYRIGQVIGTEARAVYNAGQATGMTFWAPNINIFRDPRWGRGQETPGEDPLVTGKYA
VSYVRGVQGDRPQGGGKSRGGLQASACCKHFTAYDLDRWKGVDRYDFDAQVTAQDMAD
TFQPPFQKCIQDGKASGIMCAYNRVNGVPSCADYNLLSNIARRQWSFHGYITSDCDAVSIMY
DNQKYAKTPEDAVADALKAGMDVNCGTYLQNHTKSAVEQRKVSVSEIDRALHNLFSVRMRL
GLFNGDPKKQPFGNIGPDQVCSQKHQDLALEAARSGIVLLKNKEKHLPLQRSKSASLAVIG
PNANKASNLLGNYAGPPCKSVTLLQALQSYVKDTRYQPGCDDVVCSSPQIAQAVEVAKAA
DHVVLIMGLDQTQEREDFDRVDLVLPGRQQEFITTVAQAAKKPVILVILCGGPVDIRFARDD
QNIGSILWAGYPGEAGGMALSEIIFGEHNPGGRLPVTWYPQEFTRVPMTDMRMRPEPSTG
YPGRTYRFYQGQSIFEYGHGLSYTEYSYKFISVTRELFYLSQSAKSQPDEASDASPRYRLVS
DLGADFCKKSNFVATVKVKNHGDMVGKHPVLLFVRHAKPSSGSPMKQLVAFQSVELKGGE
TMKVQLALNPCDHLSRANENGVMILEEGWRFLEVGDQEYPINVMA

Figure 162: Amino Acid sequence of 396. The conserved N-terminal and C-terminal domains of glycoside hydrolases family 3 are underlined.

MSVMGRYSVPIKAFLLICCLAAVTTEAEYVKYRDAKQP<u>MGARVRDLMRRMTLAEKIGQMTQI
ERSVATPDVMKNYFIGSVLSGGGSVPAPKASPETWVNAVNEIQKAALSTRLGIPMIYGIDAVH
GHNNVYNATIFPHNVGLGVTRDPVLLKKIGDATALEVRATGIPYAFAPCIAVCRDPRWGRCY
ESYSEDHRIVRMLTEIIPGLQGDLPANSPKGVPFVAGKNKVAACAKHFVGDGGTTKGINENN
TVVDYNGLLSIHMPAYLDAIRKGVATVMVSYSSWNGKKMHANGDLVTGFLKNKLKFKGFVIS
DWEGIDRITSPPHANYSYSVQAGVGAGIDMVMVPYKVTEFLDDLTKQVQNNVIPMSRIDDAV
KRILRVKFVMGLFDNPLADNSLANQVGSPEHRELAREAVRKS</u>LVLLKNGKSSGKPLIPLPKKA
QKILVAGSHADNLGNQCGGWTIAWQGLNGNDLTTGTTILNAVKSTVHPDTQVVYNENPDAN
FVKSNNFAYAIVVVGEPPYAETFGDSLNLTIPEPGPSTIRNVCGSVKCVVVVISGRPVVIEPYV
SNIDALVAAWLPGTEGQGVADLLFGDYGFTGKLARTWFRSVDQLPMNVGDPHYDPLYPFGF
GLTTKGTKESDPTYS

Figure 163: Amino Acid sequence of 397. The conserved Glycoside hydrolase, family 5, domain is underlined.

MAHCRHHPLVLLCSLFVFLPSILAQTADFNLPLRAINLGNWLVTEGWMMPSRFDGLIGQLLD
GAQVQFKSTQLKKFLCAEGANIVINRDRAAGWETFRLWRISDTKFNIRAFNKNFVGLKDKKIVI
AEVYGTPSASETFEIIRNPNRPNRVRLRASNELFLQAKTLTSVTADYNGDTNWNDNDPSIFDI
NIVGGLQGEYQITNGYGPSTAPQLLRDHWNNYITEQDFRFMATNNVTAVRIPVGWWIAYDPT
PPKPFVGGSLYALDRAFTWAENYRMKVIVDLHAAPGSQNAESHSATRDGFVEWGDSYIQET
VKVIEFLAARYCNRSALVAIELMNEPRAPDVKLNDLIDYYRLGYEAVRRYTMDAYVILSNRLG
PADPLELFQFVRGLSRVVIDVHYYNLYDPKFKQWNLQQNIGYIYVDRENDLSKITQKRGPLSF
VGEWTSALDFDGATKEDSGRFAKAQQDVYRQATFGWAYRSYKCHYDTWSLEQMIEDGLIKI
VA

Figure 164: Amino Acid sequence of 398. The conserved glycoside hydrolase, family 3, N-terminal domain is underlined, and the Glycoside hydrolase, family 3, C-terminal is in bold MGSAEDARCVYKDPNAA<u>IEDRVNDLLSRMTLQEKVGQMTQIERRVATPSVLSGLSIGSILSA
GGSGPFGVIGSESSKQALSSDWADMVDGFQKAALESRLGIPLIYGIDAVHGNNSIYGATIFPH
NIGLGATRDAELVRRIGVATALEVRASGIPYTFAPCVAVLKDPRWGRSYESYSEDTDIVRKMT
PIVAGLQGQPPQGHPKGYPFVAGRNNVIACAKHFVGDGGTERGVNEGNTVTSYEDLERIHM
APYLDCISQGVCTVMASYSSWNGRRLHSDYFLLTEVLKDKLGFKGFVISDWEGLDRLSQPH
GSNYRQSISLAVNAGIDMIMVPFRHEQFAEDLTALAESG</u>EVPMSRIDDAVQRILRVKFVSGLF
EHPFSDRSLLQIVGCKSHRELAREAVRKSLVLLKNGKDPMKPFLPLDKNAKKILVAGSHAD
DLGYQCGGWTATWHGSSGRITIGTTILDAIKEAVGGNTEVIYEQNPSPSTLASHDYTFAIVA
VGEGPYAETLGDNPELAIPFNGTDVIKSVAERIPTLVLVVSGRPLVIEPHVLEKIDALVAAWL
PGSEGTGITDVVFGDYDFEGQLPISWFRTVEQVPMDHKANSYDPLFPLGFGLKCKKEA

Figure 165: Amino Acid sequence of 399. The conserved N and C terminal domains of family 3 of The Glycoside hydrolases are underlined.

MGSAEDARCVYKDPNAAIEDRVNDLLSRMTLQEKVGQMTQIERRVATPSVLSGLSIGSVLSG
GGSGPLGLAESASSERALLSDWTDMVDFQKAALESRLGIPLIYGIDAVHGNNNIYGATIFPH
NIGLGATRDAELVRRIGVATALEVRASGIPYTFAPCVAVLKDPRWGRSYESYSEDTDIVKKMT
AIVTGLQGQPPQGHPKGYPFVAGRNNVIACAKHFVGDGGTERGVNEGNTVTSYEDLERIHM
APYLDCISQGVCTVMASYSSCNGRRLHTDYFLLTEVLKNKLGFKGFVISDWEGLDRLSQPHG
SNYRQSISLAVNAGIDMIMVPFRHEQFAEDLIALAESGEVPISRIDDAVQRILRVKFVSGLFEH
PFSDRSLLQIVGCKSHRELAREAVRKSLVLLKNGKEPTKPFLPLDKNAKKILVAGSHADDLGY
QCGGWTVAWHGSSGRITIGTTILDAIKEAVGGNTEVIYEQNPSPSTLASHDYTFAIVAVGEGP
YAETLGDNAELAIPFNGTDVIKSVAERIPTLVLVVSGRPLVIEPHVLEKIDALVAAWLPGSEGT
GITDVVFGDYDFEGQLPVSWFRTVEQLPMDHKANSYDPLFPLGFGLKCKKEA

Figure 166: Amino Acid sequence of 400. The conserved N and C terminal domains of family 3 of The Glycoside hydrolases are underlined.

MGSAEDARCVYKDPNAAIEDRVNDLLSRMTLQEKVGQMTQIERRVATPSVLSGLSIGSVLSG
GGSGPLGLAESASSERALLSDWTDMVDFQKAALESRLGIPLIYGIDAVHGNNNIYGATIFPH
NIGLGATRDAELVRRIGVATALEVRASGIPYTFAPCVAVLKDPRWGRSYESYSEDTDIVKKMT
AIVTGLQGQPPQGHPKGYPFVAGRNNVIACAKHFVGDGGTERGVNEGNTVTSYEDLERIHM
APYLDCISQGVCTVMASYSSWNGRRLHTDYFLLTEVLKNKLGFKGFVISDWEGLDRLSQPH
GSNCRQSISLAVNAGIDMIMVPFRHEQFAEDLIALAESGEVPISRIDDAVQRILRVKFVSGLFE
HPFSDRSLLQIVGCKSHRELAREAVRKSLVLLKNGKEPMKPFLPLDKNAKKILVAGSHADDLG
YQCGGWTVAWHGSSGRITIGTTILDAIKEAVGGNTEVIYEQNPSPSTLASHDYTFAIVAVGEG
PYAETLGDNPELAIPFNGTDVIKSVAERIPTLVLVVSGRPLVIEPHVLEKIDALVAAWLPGSEGT
GITDVVFGDYDFEGQLPISWFRTVEQVPMDHKANSYDPLFPLGFGLKCKKEAR

Figure 167: Amino Acid sequence of 401. The conserved N and C terminal domains of family 3 of The Glycoside hydrolases are underlined.

MKKNGESSHLYGGILVLCCFSGVTRAEYLKYKDPKQPLNTRINDLLSRMSLEEKIGQMTQIER
SVASFEVMKKYYIGSVLSGGGSVPAPQASAETWIDMVNDFQNGSLSTRLGIPMIYGIDAVHG
HNNVYRATIFPHNVGLGATRDPALVKRIGAATALEVRATGIPYVFAPCIAVCRDPRWGRCYE
SYSEDPKIVQAMTEIIPGLQGDLPAGSRKGVPYVAGKKNVAACSKHYVGDGGTTNGVNENN
TVTDWHGLLGIHMPGYYTSIIKGVSTVMVSYSSWNGVKMHANGNLVTGFLKNKLRFRGFVIS
DWEGIDRITSPPHANYSYSIQAGISAGIDMVMVPSNFTEFIDGLTFQVKNKIIPMSRIDDAVRRI
LRVKFTMGLFEDPLADTSLVNQLGSQEHRELAREAVRRSLVLLKNGEGADAPLLPLPKKAPKI
LVAGSHADNLGYQCGGWTIQWQGLSGNNLTSGTTILSAIKNTVDPKTKVVYEENPDTDTVKS
GKFSYAIVVVGEHPYAETFGDSSNLTIADPGTSTIGNVCGAVKCVVVIISGRPVVIQPYVAVMD
AIVAAWLPGTEGQGVADVLFGDYGFTGKLPRTWFKTVDQLPLNVGDPHYDPLFPFGFGLTT
APVKRN

Figure 168: Amino Acid sequence of 402. The conserved N and C terminal domains of family 3 of the Glycoside hydrolases are underlined.

MGGAFLRTLGVLTLWWFVASVMAQSADYVAYKDPKQP<u>VAARVKDLLSRMTLEEKIGQMTQI
DRMVATDDFMKTYSIGSVLSGGGSTPLPEASAEDWVNMINGYQKGALSSRLGIPMIYGIDAV
HGHNNVYNATIFPHNIGLGATRDPKLVKKIGAATALEVRATGIPYVFAPCIAVCRDPRWGRCY
ESYSENEDIVRQMTEIIPGLQGDIPSGSRKGVPYVDGKNKVAACAKHFVGDGGTSKGINEDN
TVVDMHGLLSIHMPAYTDAIIKGVSTVMVSYSSWNGEKMHANRDLVTGFLKNTLKFKGFVIS
DWQGIDRITSPPHANYTYSVEAGILAGIDMVMVPFNFTEFINDLTYL</u>VKEKVIPMDRIDDAVGR
ILFVKFTMGLFENPLADLSLVNELGSQAHRELAREAVRNS<u>LVLLKNGKNETDPLLPLPKKPKKI
LVAGSHADNLGYQCGGWTITWQGFSGNNYTRGTTILSAINSTVDLSTEVVYQENPDKDFVK
STDFDYAIVVVGEHPYAETAGDSTTLTMADPGPTTITNVCEAMKCVVIVVSGRPLVIEPYISSI
DALVAAWLPGTEGQGVADVLFGDYGFSGKLPRTWFKSVDQLPMNFGDLHYDPLFPFDFGL
KTES</u>VPGLVARATSHGADGGPRLLMVTACLAISLYVTGYRWRASKF

Figure 169: Amino Acid sequence of 403. The conserved glycosyl hydrolases domain of family 17 is underlined and the glycosyl hydrolases family 17 signature is in bold.

MASPAFSCLLLLVSIFALAESGS<u>VGLNWGRVANDLPPPAKVVELLKSQGITLVKLYDTYDGAL
TALAGSGISVVVALPNEQLSSAASAQSFTDSWVQSNISKYYPSTKIVAIAVGNEVFVDPNNTT
DFLVPAMNNVHASLVKYNLSDISVSSPIALSALQTSYPTSSGSFKSDLVEPVIKPMLEFLRKTG
SYLMVNVYPFFAYTANSDQISLDYALLKQNPGVVDSGNGLKYNSLFDAQVDAVYAAMSALQ
YNDLKLVVTETGWPSKGDANEVGAGTQNAAAYNGNLVRRALTGTGTPLRPNNTVDVYLFA
LFNENQKTGPTSERNYGLFYPDEQKVYSIPLTLEQLASDPNNASKAQVPTAPVGQTWCVAN
GKAGEKKLQAALDYACGKGGADCQPIQQGSACYNPNTLEAHASYAFNSYYQKNARGAGTC
NFGGAAFVVTQVPEYGECDFPTGY</u>

Figure 170: Amino Acid sequence of 404. The conserved Glycoside hydrolase, family 17, domain is underlined.

MAASFLSNPSSLSFLLLLLLLHASRLAFSQSF<u>VGVNYGQVADNLPPPESTAKLLQSTTIGKVR
LYGADPAIIKALANTGIGIVIGAANGDIPSLAADPNAAGQWVGANILPFYPASKITLVTVGNEVF
MSNDENLMSQLLPAMQNMQKAITAAGLGGKVKVSSVHAMSLLSQSDPPSSGRFHPSFEAR
MRDVLQFQRENGSPLPINPYPFFAYQSDPRPETLAFCLFQPNAGRVDSGTGIKYMNMFDAQ
VDAVYSALKALGYKDIEIVVAETGWPYNGDSNEVGPSVENAKAYNGNLIAHLRSLVGTPLMP
GKSVDTYIFALYDEDLKTGPTSERSFGMYKPDLTMSYDIGLAKSSQTPVTPTPKPTGPGWCV
PKSGVSDAQLQASLDYACSHNIDCGPIQPGGACFDPNTVASHAAFAMNLYYQTSGRNPWN
CDFSQTATLTTNNPSYNGCVYPGGST</u>

Figure 171: Amino Acid sequence of 405. The conserved family 17 glycoside hydrolase domain is underlined and the glycosyl hydrolases family 17 signature is in bold.

MAVPPFVLLLLLVGCASTVKSDQEPF<u>IGVNIGTDLSDMPHPTQVVALLKAQNIRHIRLYNTDR
GILAALANTGIQVIVSVPNEQLLGIGQSNSTAANWVSQNIIVHYPATNITGISVGSEVLTALPNA
APILVNALKFIHSALVASNLDRQIKVSTPLSSSVILDSFPPSQAFFNKSLNPVLVPMLNFLQSSG
SYLMLNVYPYYDYMQSNGVIPLDYALFKPLPSNKEAVDANTLLHYSNVFDATVDAAYFAMAF
LNFTNIPVVVTETGWPSKGDSNEPDATVDNANTYNSNLIRHVLNKTGTPKHPGITVSTYIYEL
YNEDTKAGPLSEKNWGLFDASGSPIYILHLTGSGSVLANDTTNQTYCTAKEGADPKMLQAAL
DWACGVGKVDCSPMLQGESCYEPDTLSAHATYAFDTYYHQMGKAPGTCDFNGVAAITTTD
PSHGTCIFSGSLGRNATSVNVTAPSMNSTTSGSPALNYYNQHVLLLVVDESSGLECLVLVEW
YISR</u>

Figure 172: Amino Acid sequence of 406. The conserved glycoside hydrolase, family 17, domain is underlined MAESISHYPFPTLGLIVLCFMTMFSIGSS<u>VGVNWGTQSNHQLPPEKVVKMLKENGIKKLKLFE
YDEKILGALAGSKIEVMLAVPNYMLEIMSVDPSFAASWVDTNVTSYRYTGGVNIKYIAVGNEP
FLQSYNHKYVRQVLPALRNIHEALHRARLSSKVKVTVPFNADVYYSPPPNEYPSSGDFRPEV
RDAAIEIIHFLYINDSPFTVNIYPFLSLYQNQNFPVDFAFFDGTTEPVKDGDRVYTNVFDANFDI
LVSALTKAGYSDMEILVGEIGWPTDGDKFANIKNAQRFNQGLLKHALSGDGTPARKGVIDVY
LFSLIDEDTKNIDPGNFERHWGLFEYDGKPKYELDLSGSEKDTRLVPVMGVSYMPRRWCILN
PELNDLTDLGENIDYACKSSDCTALGYGSSCNNLSSQGNASYAFNRYYQMNDQRIMACDFQ
GLAEVTENDPSTEECQFPLMLASGDSMSWNQGSLHTSFRFYLWFLVFWVIL</u>

Figure 173: Amino Acid sequence of 407. The conserved family 17 glycoside hydrolase domain is underlined and the glycosyl hydrolases family 17 signature is in bold.

MAKIISMASGCSSAPAVCLLGLLIASFCTAGVQS<u>IGVCYGMLGNNLPSASEVVALYKSRGITQ
MRLYDPSQPALQALRGSNIELILGVPNSELQALASNPANANSWVQRNVKNYSPGVRFRYIAV
GNEVSPVNGGTAQFARFVLPAMRNIQAALRSSGLQNQIKVSTAIDMTLIGNSYPPSQGAFRG
DVRSYLDPIISFLVNNNSPLLANIYTYFSYVGNPKDISLPYALFTSPSVVVRDGAHEYRNLFDA
MLDALYSALERAGGASLRVVVSESGWPSAGAFAATVDNARTYNGNLIKHVKGGTPKRPNG
AIETYIFALFDENQKQPELEKHFGLFFPNKQPKYPLSFAQGRIWDVYDNVTGPLKSDM</u>

Figure 174: Amino Acid sequence of 408. The conserved glycoside hydrolase, family 17, domain is underlined.

MGFFKFIAFSRLCVALLFLAELVTSVGG<u>IGVNWGTQTTHPLPPATVVRMLKDNGFQKVKFFD
ANSSYLSALSKSGLQVMLGIPNDMLSSLASNVEAAENWVAQNLSTYVSSNGVDIRHIAVGNE
PFLSTYNGTYLNTTLPALQNVQAAVVKAGLSTQVKVTIPLNADVLESSTNLPSDGDFRSDIRD
LMLEIVKFLSDNGAPFTINIYPFISLYNDPNFPAEFAFFDSSSSPLNDKGTIYTNVLDANHDMLV
WALQKNGYGNMSITVGEIGWPTDGDKNANAKSAQRFNQGFMTQYSAGKGTPLRPGQMDA
YLFSLIDEDAKSIQPGNFERHWGLFSEDGQPKYQLNL</u>GSTSSNGLVAARDVKYLAKKWCVM
SQSASLQDSQVAPSVSYACANADCTSLGYGNSCSNLTAQGNISYAFNSYYQQHDQLDTAC
QFPNLSVITDNDPSVGDCKFIIMIQSQSMSLVGSDGSRGRGIVPAILVSSLLYMILWMP

Figure 175: Amino Acid sequence of 409. The conserved glycoside hydrolase, family 17, domain is underlined.

MALLLLFLLLFPVSLASADEGPFIGVNIGTDLSNMPSPTQVVALLKAQNIRHVRLYDTDHAMLL
ALANSGIRVTVSVPNDQLLGIGQSNATAAYWVARNIVAHVPATNITVIAVGSEVLTTLQNAAPV
LVSAMKFIHSALVASNLDSRIKVSTPHSSSIIIDSFPPSQAFFNRTWDPVMVPLLKFLQSTGSY
LMLNVYPYYDYMQSNGAIPLDYALFRPLPPNKEAVDSNTLLHYNNVFDAVVDAAYFAMSYLN
FTNVPIVVTESGWPSKGDSSEADATLENANTYNSNLIKHVLNNTGTPKHPGVAVSTYIYELYN
EDQRPGSVSEKNWGLFDANGVPIYILHLTGAGTVLANDTTNQTFCVGKDGADKKMLQAALD
WACGPGKVDCSLLLQGQACYEPDNVVAHATYAFNAYYQKMGKALGTCDFKGVATVTTTNP
SHGSCIFPGSGGRNGTSVNGTILAPSSNSTTSGCPPQYFFDVGSITSSLIITILHLALVLL

Figure 176: Amino Acid sequence of 410. The conserved nucleotidyl transferase family domain is underlined.

MGSAEERVVAVIMVGGPTKGTRFRPLSLNIPKPLFPLAGQPMVHHPISACKRIPNLAQIYLVG
FYEEREFALYVSSISNELKVPVRYLKEDKPHGSAGGLYNFRDLIMEDSPSHIFLLNCDVCCSF
PLPEMLEAHISYGAMGTLLVIKVSAESASQFGELIADPSTKELLHYTEKPETFVSDLINCGVYIF
TPEIFSAIRNVSTQRKDRANLKRVSSFEALQPATRNLPTDFMRLDQDILSPLAGKRQLYTYET
MDFWEQIKTPGMSLKCSGLYLAQFRSTSPHLLASGDGTKGATIIGDVYIHPSAKVHPTAKIGP
NVSISANARVGAGARLMNCIILDDVEIKENAVVTHSIIGWKSSIGKWSRAQGGGDYNAKLGITI
LGEAVTVEDEVVVINSIVLPNKTMNISVQEEIIL

Figure 177: Amino Acid sequence of 411. The conserved Nucleotidyl transferase domain is underlined MENSGEMEKVVAVIMVGGPTKGTRFRPLSFNTPKPLFPLAGQPMVHHPISACKRIPNLAQIFL
IGFYDEKEFALYVSSISNELRVPVRYLKEDKPHGSAGGLYHFRNLIMEDSPSHIFLLNCDVCC
NFPLPDMLEAHKRYGGMGTMLVVKVSAESANQFDVFSAIEDVSNDREDRANLRRLSSIDIST
STRTNIPTDFVRLDQDILSPLSGKKQLYTYETMDYWEQIKTPGISLKCSGLYLAQFRLTSPHLL
ASGDGTRSATVVGDVFVHPSAKVHPTAKIGPNVSISANVRVGPGVRLISCIILDDVELEDNAIVI
NSIVGWKSSLGRWSRVQADGDYNSKLGITILGESVVVEQEVVVVNSIVLPNKILNVSVQDEIIL Figure 178: Amino Acid sequence of 412. The conserved Nucleotidyl transferase is underlined.

MKALILVGGFGTRLRPLTLSVPKPLVDFANKPMILHQIEALKAIGVSEVVLAINYQPEIMLNFLK
GFEAKLGIKITCSQETEPLGTAGPLALARDKLLDDSGEPFFVLNSDVISEYPLKEMIQFHKAHG
GEASIMVTKVDEPSKYGVVIMEESTGQVEKFVEKPKIFVGNKINAGIYLLNPSVLDRIQLRPTSI
EKEVFPKIAAEKQLFAMVLPGFWMDIGQPRDYITGLRLYLDSIRKKSSEKLATGPHIVGNVLV
DETAKIGEGCLIGPDVAIGPGCVVESGVRLSRCTVMRGVRIKKHACISSSIIGWHSTVGQWAR
VENMTILGEDVHVGDEIYSNGGVVLPHKEIKSSILKPEIVM

Figure 179: Amino Acid sequence of 413. The conserved Mannose-6-phosphate isomerase family domain (type I) is underlined, the Phosphomannose isomerase signature 1 (type I) is in bold, and the Phosphomannose isomerase signature 2 (type I) is in italics.

METRSSPKLRRLRCSVQKYDWGRRGAESRVAKLFALNSGAEADPDRPYAEFWMGTHGSG
PSFLLPAGCGNGGHKVSPDVTLKAWISSNPDVLGDKVVAEWGCDLPFLFKVLSIAKPLSIQA
HPDKELARALHKARPDVYKDANHKPEMALALTKFEAICGFISMEELKQVLCDVPEIAELVGST
DVEKFIKLGEQEVEKAKCLLQSIFTKLMSASADIVALAVSQINSRLELESQVRPLTDKEQLVLR
LEKQYPADVGVISAFFLNYVRLNPGEALYLGANEP*HAYVSGECIECMATSDNVVRAGLTPKT
KDIQTLCSMLTYKQGFPDILKGVPLKTYITRYIPPFDEFEVDRCVLPKGSSAVFSAVLGPSIFLV
TDGEGTINVGSV*KQDVVAEGYVLFVPANVEIHVTSVTELHVYRAGVNDRFLKSRELENGKKS
QI

Figure 180: Amino Acid sequence of 414. The conserved group 1 glycosyl transferase domain is underlined.

MAGNDWINSYLEAILDVGPALDDKKSSLLLRERGRFSPTRYFVEEVITGFDETDLYRSWVKA
QATRSPQERNTRLENMCWRIWNLARQKKQLEGEEAQRKSKRRLERERGRREATADMSED
LSEGEKGDAVSDISTHGDSNRGRLPRISSVDAMETWVGQQKGKKLYLVLISLHGLIRGENME
LGRDSDTGGQVKYVVELARALGSMPGVYRVDLLTRQISSPDVDWSYGEPTEMLSPRNSEG
LSDEMGESSGAYIVRIPFGPRDKYVPKELLWPHIREFVDGALSHVIQMSKVLGEQVGGGQPV
WPVAIHGHYADAGDSAALLSGALNVPMLFTGHSLGRDKLEQLLKQGRLSRDEINTTYKIMRRI
EAEELSLDSSEIVITSTRQEIDEQWRLYDAFDPILEKKLRARIKRNVSCYGRFMPRMAIIPPGM
EFHNIAPQDGDMDGEMEGNDDHPTTQDPPIWTEIMRFFNNPRKPMILALARPDPKKNITTLV
KAFGECRPLQELANLTLIMGNRDGIDEMSSTSSSVLLSVLKLIDKYDLYGQVAYPKHHKQSDV
PDIYRLAAKTKGVFINPAFIEPFGLTLIEAAAHGLPMVATKNGGPVDIHRVLDNGLLIDPHDQR
SIADALLKLVADKHLWARCRQNGLKNIHLFSWPEHCKTYLSRIASCKPRHPQWQRSEDGLG
NSESDSPSDSLRDIQDLSLNLKFSLDGEKNDASGNENSVGSEENSADRKNKLENAVMTWSK
GVLKDKKTGLVEKSDPNANSSKFPPLRRRKHIFVLAVDCDSLTDLLEIIQKVFSSVENERNEG
SIGFILSTSLTMSEVHSFLVSGGLSPNDFDAFICNSGSDLYYPSLNSENRPFVIDFYYHSHIEY
RWGGEGLRKTLVRWATNINDKRAENEAQIVTLAEKLSTDYCYTFKVEKLGMVPPVKEVRKM
MRIQALRSHAVYCQNWTRLNVIPVLASRAQALRYLYVRWGVDLSKMVVFVGECGDTDYEGL
LGGLHKSVILKGVCGSASNQFHANRNYPLSDV

Figure 181: Amino Acid sequence of 415. The conserved group 1 glycosyl transferase domain is underlined.

MAGNEWINGYLEAILDAGRYNVKRRGDGKIGGGGKGGVVATEFDGNEREGSLFSPTRYFVE
EVVNSFDESDLHKTWIKVIATRNTRERNNRLENMCWRIWHLARKKKQIAWDDAQRLAKRRL
EREQGRSEAADDLSELSEGEKEKGDGSHSPEPAKDKIARINSDLQAWSDDEKPRQLYIVLIS
MHGLVRGENMELGRDSDTGGQVKYVVELARALASTKGVYRVDLLTRQITSHEVDSSYGEPI
EMLSCPADAGDGCGAYIIRMPCGPSNEYIPKESLWPHVPEFVDGALNHIVNMARVLGEQIDG
KPVWPYVIHGHYADAAEAAALLSGVLNVPMVLTGHSLGRNKFEQLLKQGRLSREDINTTYKI
MRRIEAEELGLDAAEMVVTSTRQEIEEQWGLYDGFDLKLERKLRVRRRRGVSCYGRYMPR
MVVIPPGMDFSNVKVEDSTESESDLKSLISSDKTPNKRHLPRIWSEVMRFFSNPHKPMILALS
RPDPKKNVTTLLKAFGECQHLRELANLTLILGNRDDIEEMPEGSSVVLTNVLKLIDKYNLYGQ
VAYPKHHKQSDVPEIYRLAAKTKGVFINPALVEPFGLTLIEAAAYGLPIVATRNGGPVDILKALN
NGLLIDPHDQKAIADALLKLVADKSLWAECRKNGLKNIHCFSWTEHCHNYLSQVDHCRNRHP
TSRFQIMPIPEEPLSESLRDVEDLSLKFSIDGELKANGELDLATRQKELIEALTRKVHPNGGSP
SISLSSRRQKIFAIALDPYDSGGLFTNIFRVTIKNIMKVARGYSGLNRVGFVLLTGATLQETLNA
FKGSDINVEEFEALSCNSGSSIYYPGRDFIADVDYEGHLEYRWPGDNVRSMVLRLAKAEDG
MEDDIEELKAGCNSRCFAFSIKPGGKVRRIDDLRQALRMRGFRCHIVYSCAGTRLSVMPLFA
SRIQALRYLSIRWGIDFADSVVFVGDKGDTDYEQLLGGLHKTIILNGTVECGSEKLLRSEENFK
RVDVVALNSPRIRIVEDGSEEDISRA

Figure 182: Amino Acid sequence of 416. The conserved group 1 glycosyl transferase domain is underlined.

MAGNEWVNSYLEAILDVGPALDDPKSSSLLLRERGRFSPTRYFVEQVITGFDETDLHRSWLR
AAATRSPQERNTRLENMCWRIWNLARKKKQLEGEEAQRIAKRRLEHERGRREATADMSED
LSSEGEKGDSATDISSQGGERMPRTGSVDIMDKWASRQKDCKLYLVLISLHGLVRGENLEL
GRDSDTGGQVKYVVELARALGTIPGVYRVDLLTRQISAPDVDWSYGEPTEMLRTRNSEFPL
QEIGESSGSYIIRIPCGPRNKYVQKELLWPHIPEFVDGALSHITQMSKVLGEQIGGGRPVWPA
AIHGHYADAGDAAALLSGALNVPMLFTGHSLGRDKLEQLLKQGRLAEEINTAYKIRRRIEAEE
LSLDTSEIIITSTRQEIEQQWRLYDGFDPVLERKLRARIKRGVSCHGRYMPRFVVIPPGMEFR
NIVPHDGDMNGEVEKNP<u>IWPEIMRFFSNPRKPMILALARPDPKKNITTLVKAYGECHQLREL</u>
<u>ANLTLIMGNRDDLDEMSTTNAAVLLSILKLIDKYNLYGQVSYPKHHKQSDVPDIYRLAAKTKG</u>
<u>VFINPALIEPFGLTLIEAAAYGLPVVATKNGGPVDILRVLDNGQLVDPHDQHAIANALLKLVSDK</u>
<u>QLWSRCRENGLKNIHLFSWPEHCRTYLSRIISCKPRGPQWQNNDDKLDKSESDSPGDSLRD</u>
IQDISLNLKFTLDGEKSEGNATFLEENADDAKSNVENTVLTLAKGVLRGIAKGTSTEKANEDIG
AGDFSTFRRRKWIYVIAVDCDATADYIDIIKRIMEATRKENAAGFILSTALTILEVHSLLTSGGLN
LTDFDAFICSSGSDLLYPSSSSDDGPSGLPFVIDLDYRSHIEYRWGGEGLRKTLVRWAASIND
KKDGENIVAEDESGSSSYCFSFKVEDYDLIPPVKELRKLMRIQALRCHVVCCQNGRKLNVIPV
LASRVQALRYLFVRWGMDLSKFVVFVGECGDTDYEGLIGGVHKTVILKGLGCESRKLHAHR
GYPLEHVVPYDSPNVAEAEGSD

Figure 183: Amino Acid sequence of 417. The conserved Glycoside hydrolase, family 16, domain is underlined.

MASPAWALFLGLVLMASGAMGAAPRKPVAVP<u>FGRNYMPTWAFDHIKYFNGGSEIQLSLDKY</u>
<u>TGTGFQSKGSYLFGHFSMDIKLVAGDSAGTVTAFYLSSQNSEHDEIDFEFLGNRSGQPYIVQ</u>
<u>TNVFTGGKGDREQRIYLWFDPTAAYHSYSVLWNMYQIVFFVDDVPIRVFKNSKDLGVKFPFN</u>
<u>QPMKLYSSLWNADDWATRGGLEKTDWSKAPFVASYRGFHIDGCEASVEAKFCATQGQRW</u>
<u>WDQKEFQDLDAFQYRRLRWVRSKYTIYNYCADRKRYPAMSPECRRDRDV</u>

Figure 184: Amino Acid sequence of 418. The conserved glycoside hydrolase, family 16, domain is underlined and the beta-glucanase domains are in bold.

MAFQGVLSNKMAMALVALGLLVAAAAASGN<u>FNKDFDITWGDGRAQIPSSGQLLTLSLDKTS</u>
<u>GSGFRSKKQYLFGKIDMQLKLVPGNSAGTVTAYYLSSLGSAHDEIDFEFLGNLSGDPYTLHT</u>
<u>NVFTQGKGNREQQFHLWFDPTKDFHTYSILWNPQSIIFSVDGTPIREFKNLESKGVAFPKSQ</u>
<u>AMWIYSSLWNADDWATRGGLVKTDWTQAPFTASYRGFNDEQACVGSSGSSSCSSSSGDK</u>
SWLSQSLDATGQQRIKWVQKNYMIYNYCADTKRFSQGFPPECSLS

Figure 185: Amino Acid sequence of 419. The conserved glycoside hydrolase, family 16, domain is underlined and the beta-glucanase domains are in bold.

MASPSAPSLCITTLLLVVVSWATSASARN<u>FYQDFDITWGDGRAQILNNGDLLTLSLDKASGS</u>
<u>GFQSKNEYLFGKIDMQLKLVPGNSAGTVTAYYLSSNGSTWDEIDFEFLGNLSGDPYILHTNV</u>
<u>FSQGKGNREQQFYLWFDPTADFHTYSILWNPQRIIFSVDGTPIREFKNAESIGVPFPKAQPM</u>
<u>RIFSSLWNADDWATRGGLVKTDWTQAPFTASYRNFNADNTCIWSSGSSSCTSSSSSSDGN</u>
AWLSEELDSTSQERLKWVQSNYMIYNYCTDAKRFPQGLPRECAMS

Figure 186: Amino Acid sequence of 420. The conserved glycoside hydrolase, family 16, domain is underlined and the beta-glucanase domains are in bold.

MASRSTSSLCRAALLLMVVSWATSASARNFYQDFDITWGDGRGQILNNGDLLTLSLDKASG
SGFQSKNEYLFGKIDMQLKLVPGNSAGTVTAYYLSSNGSTWDEIDFEFLGNLSGDPYILHTN
VFSQGKGNREQQFYLWFDPTADFHTYSILWNPQRIIFSVDGTPIREFKNAESIGVPFPKAQP
MRIFSSLWNADDWATRGGLVKTDWTQAPFTASYSNFNADNACVWSSGSSSCTSSSSSSDG
NAWLSEELDSTSQESLKWVQSNYMIYNYCTDAKRFPQGFPPECSMS

Figure 187: Amino Acid sequence of 421. The conserved glycoside hydrolase, family 16, domain is underlined and the beta-glucanase domains are in bold.

MASRSTSSLCTTALLLLVVSWAASAFARNFYQDFDITWGDGRAQILNSGDLLTLSLDKASGS
GFQSKNEYLFGKIDMQLKLVPGNSAGTVTAYYLSSNGSTWDEIDFEFLGNLSGDPYILHTNV
FSQGKGNREQQFYLWFDPTADFHTYSILWNPQRIIFSVDGTPIREFKNAESIGVPFPKAQPM
RIFSSLWNADDWATRGGLVKTDWTQAPFTASYRNFNADNACVSSSGSSSCTSSSSSSDGN
AWLSEELDSTSQERLKWVQSNYMIYNYCTDAKRFPQGVPPECTMS

Figure 188: Amino Acid sequence of 422. The conserved Glycoside hydrolase, family 16, domain is underlined.

MASLSTSSLCIATLLLVVVSWGTFASARNFYQDFDITWGDGRAQILNNGDLLTLSLDKASGSG
FQSKNEYLFGKIDMQLKLVPGNSAGTVTAYYLSSNGSAWDEIDFEFLGNLSGDPYILHTNVFS
QGKGNREQQFYLWFDPTADFHTYSILWNPQRIIFSVDGTPIREFKNAESVGVPFPKAQPMRI
FSSLWNADDWATRGGLVKTDWTQAPFTASYRNFNADNACVWSSGSASCTSSSSSSDGNA

Figure 189: Amino Acid sequence of 423. The conserved glycoside hydrolase, family 16, domain is underlined and the beta-glucanase domain is in bold.

MAHEGGGPSASSMVVFVSLLLMAAASPAAGNFYQDFDLTWGGSDRAKIFSGGQLLSLSLDR
VSGSGFRSKKEYLFGRIDMQLKLVAGNSAGTVTAYYLSSQGPTHDEIDFEFLGNLSGDPYIL
HTNVFTQGKGNREQQFYLWFDPTRNFHTYSVIWKPQHIIFLVDNIPIRVFKNGESIGVPFPKN
QPMKIYSSLWNADDWATRGGLIKTDWSKAPFTAYYRKFQATACTWSTGSSSCEIGRPASYS
GSTWKINELDAYGRRRLRWVQKYFMIYDYCADGKRFPQGIPAECKRSRF

Figure 190: Amino Acid sequence of 424. The conserved glycoside hydrolase, family 16, domain is underlined and the beta-glucanase domain is in bold.

MAHEGGGPSASSMVVLVSLLLMAAASPAAGNFYQDFDLTWGGSDRAKIFSGGQLLSLSLDR
VSGSGFRSKKEYLFGRIDMQLKLVAGNSAGTVTAYYLSSQGPTHDEIDFEFLGNLSGDPYIL
HTNVFTQGKGNREQQFYLWFDPTRNFHTYSVIWKPQHIIFLVDNIPIRVFKNGESIGVPFPKN
QPMKIYSSLWNADDWATRGGLIKTDWSKAPFTAYYRKFQATACTWSTGSSSCEIGRPASYS
GSTWKINELDAYGRRRLRWVQKYFMIYDYCADGKRFPQGIPAECKRSRF

Figure 191: Amino Acid sequence of 425. The conserved glycoside hydrolase, family 16, domain is underlined and the beta-glucanase domain is in bold.

MAVPVFSKVSVSFGLFVGLALLVGLVAGARFEELYQPGWAMDHFVYEGEVLKLKLDNYSGA
GFGSKSKYMFGKVTIQIKLVEGDSAGTVTAFYMSSDGPNHNEFDFEFLGNTTGEPYLVQTN
VYVNGVGNREQRLGLWFDPTTDFHSYSVLWNQRQVVFLVDETPIRVHTNLEHRGIPYPKDQ
PMGVYSSIWNADDWATQGGRIKTDWTHAPFITSYRNFEIDACECPATMAAADNAKRCSSAG
RERRYWWDEPTVSELSLHQNHQLKWVQAHHMVYDYCKDTARFPVMPAECEHHRH

Figure 192: Amino Acid sequence of 426. The conserved glycoside hydrolase, family 16, domain is underlined and the beta-glucanase domain is in bold.

MASAALAMILFTSVLLKSLMVASAGN<u>LNQEFDITWGDGRAQILNNGDLLTLSLDKASGSGFQ</u>
<u>SKNEYLFGKIDMQLKLVPGNSAGTVTAYYLSSKGSTWDEIDFEFLGNLSGDPYILHTNVFSQ</u>
<u>GKGNREQQFYLWFDPTADFHTYSILWNPQRIIFSVDGTPIREFKNAESSGVPFPKSQPMRIY</u>
<u>SSLWNADDWATRGGLVKTDWSRAPFTASYRNFNADACVWSSGSSSCGSGAASSDGSSWL</u>
<u>TQELDTTSQQRLKWVQQNYMIYNYCSDSKRFPQGPPPECNLS</u>

Figure 193: Amino Acid sequence of 427. The conserved glycoside hydrolase, family 16, domain is underlined and the beta-glucanase domains are in bold.

MQDSRMEKMVSPLSILLCISLVLLAEPRSSDAAPQSKG<u>SFVDNFDIMWSEEHFKTSADGQIW</u>
<u>YLSLDKETGCGFQTKQRYRFGWFSMKLKLVGGDSAGVVTAYYMCSENGAGPERDELDFEF</u>
<u>LGNRSGQPYLIQTNVYKNGTGSREMRHMLWFDPTEDFHSYSILWNSHQIVFFVDQVPVRVF</u>
<u>KNNGEANNFFPNEKPMYLFSSIWNADDWATRGGLEKTDWTKAPFVSTYKDFSFDGCQWED</u>
<u>PFPACVSTTTKNWWDQYSAWHLSEDQKKDYAWVQRNLVIYDYCKDTQRFPTLPWECSLSP</u>
<u>WD</u>

Figure 194: Amino Acid sequence of 428. The conserved glycoside hydrolase, family 16, domain is underlined MLHSHLGLLSLTCFAVLLVLASGSSPNLPIIS<u>FDEGYTQLFGDNNLALHGDGQSVHLALDERT</u>
<u>GSGFASQDLYLHGFFSASIKLPADYTAGVVVAFYMSNGDMYEKNHDEIDFEFLGNIREKNWR</u>
<u>IQTNIYGNGSTSVGREERYGLWFDPSDDFHQYGILWTDSQIIFYVDNVPIREFKRTEAMGGQ</u>
<u>FPSKPMSLYATIWDGSDWATNGGKYRVNYKYAPYVAKFSDLVLHGCAVDPIEHQLSCNDVP</u>
<u>SHKAIPQGISPRQRTKMEYFRKKHMTYSYCYDRARYKVPPPECVINPGEAEHLRVFDPVTFG</u>
<u>DGRHHRPKRHRQSRTSRADASI</u>

Figure 195: Amino Acid sequence of 429. The conserved Glycoside hydrolase, family 16, domain is underlined.

MSASWSVTSCLFFASCALLVVLAVGSPENSNSELPVVS<u>FDEGYAHLFGDDNLVIHGDGKSV</u>
<u>HLTLDERTGSGFVSQDLYLHGFFSASIKLPADYTAGVVVAFYMSNGDMFEKTHDEIDFEFLG</u>
<u>NIRGKEWRVQTNVYGNGSVGVGREERYNLWFDPSDDFHQYSILWTDSLIVFYVDNVPIREV</u>
<u>KRTKAMGGDFPSKPMTLYATIWDGSSWATNGGKYRVSYKYAPYIVEFSDLVLHGCAVDPME</u>
<u>HSSACDAVLPSGSIPTAITREQRVQMESFRKRHMTYSYCYDRARYKIPPPECILSVKEAKHLR</u>
<u>SFDPVTFGQGKRHFAKRRHRRVSATSM</u>

Figure 196: Amino Acid sequence of 430. The conserved Glycoside hydrolase, family 16, domain is underlined MALLYLSLLLVLLMLPICPGNAQWPPAPGYWPSSRFRSMS<u>FYQGFKNLWGPQHQRVDQSA</u>
<u>LTIWLDSTSGSGFKSVKPFRSGYFGASIKLQPGYTAGVITSFYLSNGEAHPGFHDEVDIEFLG</u>
<u>TTFGKPYTLQTNVYIRGSGDGRIIGREMKFHLWFDPTQAFHHYAILWRPNELIFLVDDIPIRRY</u>
<u>PRKSAATFPMRPMWLYGSIWDASSWATEDGKYKADYRYQPFIARYTNFKASGCSAYSPAW</u>
<u>CRPVSASPYRSGGLTRQQYRVMRWVQAHHMVYNYCRDSRRDHSLTPECRI</u>

Figure 197: Amino Acid sequence of 431. The conserved glycoside hydrolase, family 16, domain is underlined MKYLRSFLVIVSVLNLVCVSFSSVVSTGN<u>FNKDFFVMWSPDHVNTSADGRTRSMVLDQESG
AGFSSNDMFLFGQIDMKIKLISGHSAGTVVAFYLTSDQPNRDEIDFEFLGNVSGQPYILQTNV
YADGFDNREERIYLWFDPTQDFHNYSILWNLHQIVFFVDSIPIRTYRNHADKGVAFPRWQPM
GVKATLWNGDSWATRGGHDKIDWSKGPFVASFGDYKMDACVWKGNPRFCRAESPTNWW
NNEDFSSLTSTQRRWFKWVRRYHMIYDYCQDNARFQNNLPKECSLPKY</u>

Figure 198: Amino Acid sequence of 432. The conserved glycoside hydrolase, family 16, domain is underlined.

MTSPSTRLCVCLFHLAAISALASAGN<u>FYKDFDITWGDHRSQILNGGQELTLSLDQASGSGFK
SKNEYLFGRIDMEIKLVEGNSAGTVNAYYLSSQGPTHDEIDFEFLGNLSGNPYTLHTNVFSQ
GKGNREQQFHLWFDPTKAFHTYSIVWNTRRIIFLVDNSPIRVFNNLESIGVPFPSNQPMRIYS
SLWNADDWATMGGRVKTDWTKAPFTASFRNFNANACVVSSGSSSCGSKSTNNLQTSAWQ
EQSLNAAGRNRLRWVQQKYMIYNYCSDSKRFPQGLPPECKRSRFL</u>

Figure 199: Amino Acid sequence of 433. The conserved glycoside hydrolase, family 16, domain is underlined.

MPTSISSYSFPRTTMLVVCAILIGSSVVALAGN<u>FYQDFDVTFGDGRVKVLDNGQLVTLSLDKA
SGSGFKSKNQYLYGKFDMQIKLVPGNSAGTVTTLYLHSDGSTWDEIDLEFLGNLSGDPYILH
TNLYSQGKGNREQQFYLWFDPTADFHTYSVLWNPVHVVYYVDGIPIREFKNLNAAGVPYPK
SQPMTLYSTLWDAEDWATRGGLVKTDWSQAPFTASFSGFNASACVWSNGASTCLSSSAAS
AKYPWFSQQLDAASLQTMKSVQQKYMIYDYCKDTKRFPQGLPLECTLKTKS</u>

Figure 200: Amino Acid sequence of 434. The conserved glycoside hydrolase, family 16, domain is underlined.

MALLQENTLFFSLLFLLCMAISVSSHNRPYSPPDVPRLTDLFPHVA<u>VDQGFSKFFGAQNVRLL
NNGSYANLALDKSSGSGLVSRSKYHYGFFSAAVKLPAGLSSGVVVAFYLSNADAFPHSHDEI
DIELLGHDKRNDWVLQTNIYSNGSVSTGREEKFYFWFDPTQEHHYYSIIWNSHHIVFFVDNIP
VREFPSSGVFSSTYPSKPMSVYATIWDGSQWATHGGKYPVNYKYAPFVVSLAETEMVGCV
SNPRQQPLSSCSNQSTSSGSDPVEGQDFAALSQQQITAMQWARSKLMFYSYCKDTSRFKV
MPPECK</u>

Figure 201: Amino Acid sequence of 435. The conserved glycoside hydrolase, family 16, domain is underlined.

MDPLRRLVSLAVTTSSSSSSSSSLTLLLALLFYAASAAAAFDIVPIT<u>FDEAYAPLFGDSNVVRS
GDGKSVRLLLDRFSGSGFISSNLYKYGFFSARIKLPSDYTAGIVVAFYTSNGDVFEKTHDELDI
EFLGNIKGKKWRFQTNVYGNGSTSRGREERYTLWFDPTRAFHRYSILWTANNIIFYVDEVPIR
EIIRNDAMGGDFPAKPMALYATIWDASDWATSGGRYKVNYKYAPFVAEFKDLVLQGCPVDPI
DQYSSGHCYDKLALLEAQDFATVTAQRHAAMRRFRQNYMYYSYCYDTVRYAIPPPECVILQ
SEKERFKDTGRLKFGGSHKKRSRRRGHRIPLVSEEQPVM</u>

Figure 202: Amino Acid sequence of 436. The conserved glycoside hydrolase, family 16, domain is underlined MDRHPPPHSRRFSLYQPPSYFSLSLLSIFIFSCFLSTSDAAFDVTPIS<u>FDEGYRPLFGDGNVV</u>
<u>RSPAGDGVRILLDRFTGSGFISSDMYQHGFFSAKIKLPSDYTAGVVVAFYTSNGDVFEKTHD</u>
<u>ELDIEFLGNIRGKPWRFQTNVYGNGSTSRGREERYTLWFDPTKEYHRYSILWTANKIIFYVDE</u>
<u>VPIREIVKSEAMGGDFPSKPMSLYATIWDASDWATSGGRYKVNYKYAPFVAEFKDLVLEGC</u>
MADPIRQLPASGCHAKDAQLEARDFATITSSQRRAMRRFRERYMYYSYCYDTLRYPVPPPE
CMIIPSEKARFKDTGRLKFGGSHKRRSRRRERIPAASVSDNQASM Figure 203: Amino Acid sequence of 437. The conserved glycoside hydrolase, family 16, domain is underlined.

MSHPRTQMAISKRRSPSCSLIALTMMVWLWSSHVVPRVAGCDG<u>FDELFQPNWAPEHFECE</u>
<u>GDQTKLTLDSSSGCGFGSRKAYLFGLTSVQIKLVQGDSAGTVTAFYMSSDGPNHDELDFEF</u>
<u>LGNLSGEPYLVQTNVYVNGTGDREQRHSLWFDPTTDFHTYSLFWNRRYITFLVDGIPIRVFA</u>
<u>NKEESHGVPYPKNQPMRVLGSVWNADDWATQGGRVKTNWSH</u>APFVSSFRAFDIDACELS
PETADVTTKCGQLGRYWWDRPSFNELGRRQSRQLKWVCKKYLVYDYCEDKPRFSELPKEC
VG

Figure 204: Amino Acid sequence of 438. The conserved plant disease resistance response protein family domain is underlined.

MAKPGLTAMVVAALALV<u>VAMVATLAHAEADDPKKVDAWFNGLSHADRKTTRLHFYFHDTLS</u>
<u>GRNPTAVRVAEATMTEKSPTLFGVVNMIDDPLTEGPEPESPLVGRAQGFYGSVGLESMALH</u>
<u>MNMNLVFTTPEYNGSTLSILGHNPALETYREMPIVGGTGVFRLASGVVTAKTYFLNLTTGDA</u>
<u>VVEYKVIALHY</u>

Figure 205: Amino Acid sequence of 439. The conserved plant disease resistance response protein family domain is underlined.

MAKPGLTAMVVAAVALVVAAVALV<u>VAMVAKHAHAEADDPEKVDAWFNGLSHADRKTTRLHF</u>
<u>YFHDTLSGSNPTAVRIAEAKSPTGFGVVNMIDDPLTKGPEPESPLVGRAQGFYGSVGLESTA</u>
<u>LHMSMNLVFTTPEYHGSTLSILGRNPALETYREMPIVGGTGVFRLASGVVTAKTYFLNLTTGD</u>
<u>AVVEYKVIALHY</u>

Figure 206: Amino Acid sequence of 440. The conserved plant disease resistance response protein family domain is underlined.

MGARVIVSL<u>LFLFLIFGSNADAANKRIRNRRPCKRLVFFFHDVLYNGNNAKNATSAIIGAPAWA</u>
<u>NQTILAGQSHFGDLVVFDDPITLDNNLHSKPVGRAQGFYIYDKKDIFTAWLGFSFVFNSTQHT</u>
<u>GSLNFAGADPLMNKTRDISVIGGTGDFFMARGVATLMTDSFEGEVYFRLRTDIKLYECW</u>

Figure 207: Amino Acid sequence of 441. The conserved plant disease resistance response protein family domain is underlined.

MATLSPISSLLLLLLLLLSSGSPTLAS<u>AFATALDPSLMGINLGKEKLSHFRFYWHDVQSGPHPS</u>
<u>SVTVVPPPSNSSATFFGLINMIDNPLTLRPDPGSELVGRAQGLYSSASQEEVGLLMIMNFAFV</u>
<u>AGKYNGSGITVLGRNPVLQKVREMPVISGCGLFRFARGYAQATTHTFDRKTGDAVVEYNVY</u>
<u>VLHY</u>

Figure 208: Amino Acid sequence of 442. The conserved plant disease resistance response protein family domain is underlined.

MATLIPISSLLLLVLLSSAAPAPAS<u>AFATALDPSLMGVHLGKEKLSHFRFYWHDVLSGPNPSS
VRVTTPPSNASATGFGLVNVIDNPLTLLPDPASELVGRAQGLYSSASQEEVALLMIMNFAFVS
GKYNGSGITVMGRNPVFHKVREMPVISGCGVLRFARGYAQASTHTFDLKTGNAVVEYNVYV
LHY</u>

Figure 209: Amino Acid sequence of 443. The conserved plant disease resistance response protein family domain is underlined.

MVKPGLTAMVVAALALALATAVAL<u>ACAEVDDPEKVNAWFNRLSHAEHKTTHLHFYFHDTLSG
KNPTAVRIAEATMTEKSPTLFGVVNMIDDPLTEGPEPESPLIGRAQGFYGSVGLESLALHMNV
NLVFTTPEYNGSTLSILGRNPALETYREMPIVGGTGVFRLASGVATAKTYFFNLTTGDAVVEY
KVIAMHY</u>

Figure 210: Amino Acid sequence of 444. The conserved plant disease resistance response protein family domain is underlined.

MALISAPKMLTATTFSQ<u>LLLLSTYSILMHSYSSKATVQHPHTTKLVLYFQDIIAGPNANDIPVVG
IPGKLWSFSQFGTVFVADEPITETPDPNSAMVGRAQGMYVISSLDGSNVKTVFSIVFTNQAY
NGSTLELQGAGKQLQRVLEFAVVGGTGKFRFARGYTTLETISFSQGHGVIQFNVTVRHD</u>

Figure 211: Amino Acid sequence of 445. The conserved plant disease resistance response protein family domain is underlined.

MRNLVAHKSCFLV<u>LFLLLLFTSQFSSATKKTFNRDQPCKRFVLYFHDILFGGNDVANATSAAV
ANETGLGNFKFGKLFVFDDPMTKDKNYLSPAVARAQGFYFYDMKNDYNAWFAYSLVFNSTE
HKGTLNIMGADIMAAQTRDLSIVGGTGDFFMARGIATFETDLFQGAKYFRIKMDIKLYECY</u>

Figure 212: Amino Acid sequence of 446. The conserved plant disease resistance response protein family domain is underlined.

MAVHIAKLVAFSLLCMS<u>TVFVAANSHTFARSLLPQELGLKKEKLSHLHFYFHDIVSGRNPTAV
RVAEAKMTNSSATGFGAVVMIDDPLTEGPEMSSKEVGRAQGIYALSSQNDVGLLMVQNYVF
TEGKYNGSTLSVLGRNAVFSGVREMSIVGGSGLFRFARGYAQAKTHTMDRKTGDTVVNYN
VYVFHY</u>

Figure 213: Amino Acid sequence of 447. The conserved expansin/Lol pI family domain is underlined and the C-terminal of the pollen allergen/expansin domain is in bold.

MASVSRVVGLVSLILFSTLAEARIPGVYTGG<u>PWQSAHATFYGGSDASGTMGGACGYGNLYS
QGYGVNTAALSTALFNNGFSCGACFEIKCANEPQWCHSGSPSILVTATNFCPPNYALPNDN
GGWCNPPRPHFDLAMPMFLKIAEYRAGIVPVSYRRVPCRKQGGIRFTINGFRYFNLVLVTNV
AGAGDINKLWVKGSKTGWMSMSRNWGQNWQSNSVLAGQSLSFRVTAGDRRTSTSWNIV
PSNWQFGQTFTGKNFRV</u>

Figure 214: Amino Acid sequence of 448. The conserved expansin/Lol pI family domain is underlined and the C-terminal of the pollen allergen/expansin domain is in bold.

MAAARVMALALAFLGVALSATRMAEARIPGIYTGG<u>PWQSAHATFYGGADASGTMGGACGY
GNLYSQGYGVNTAALSTALFNNGFSCGACFEIKCANDPQWCHSGSSSIFVTATNFCPPNYA
QPSDNGGWCNPPRPHFDLAMPMFLKIAEYRAGIVPVAYRRVPCRKRGGIRFTINGFRYFNLV
LISNVAGAGDIVRVSVKGSRTGWMSMSHNWGQNWQSNSVLVGQSLSFRVTGSDRRTSTS
WNIVPAGWQFGQTFTGKNFRV</u>

Figure 215: Amino Acid sequence of 449. The conserved expansin/Lol pl family domain is underlined and the C-terminal of the pollen allergen/expansin domain is in bold.

MTRASVVFAASLISFSLMWLADARIPGVYSGG<u>PWQTAHATFYGGSDASGTMGGACGYGNL
YSQGYGVNTAALSTALFNNGLSCGACFEIKCANDPTWCHSGSPSIFVTATNFCPPNFAQPSD
NGGWCNPPRPHFDLAMPMFLKIAEYRAGIVPVSFRRVPCRKRGGMRFTINGFRYFNLVLISN
VAGAGDIVRVSVKGARTGWMSMSRNWGQNWQSNAVLAGQALSFRVTASDRRSSTSWN</u>
MVPAGWQFGQTFTGKNFRV

Figure 216: Amino Acid sequence of 450. The conserved expansin/Lol pl family domain is underlined and the pollen allergen/expansin family C-terminal domain is in bold.

MQQRRRGSPSSSSSAAALLLGRLWLLLVLGAATTSASAQVKKRVPNAR<u>WKPATATWYGSP
DGDGSDGGACGYGSMVDVRPLRARVGAVSPVLFKNGEGCGACYKVKCLDRGICSRRAVTII
VTDECPGGYCSGGNTHFDLSGAAFGRMAIAGEAGPLRNRGVLPVQYRRTPCKYPGKNIAFH</u>
**VNEGSTDYWLSLLVEFEDGDGDVGSMHIRPASSSEWIEMKHLWGANWCITGGPLQGPFSV
KLTSLSTNRTLSARDVIPGNWSPKATYTSRLNFF**

Figure 217: Amino Acid sequence of 451. The conserved expansin domains are underlined and the Expansin/Lol pl family domain is in bold.

MANFAAISAVALVFLCLKSAFGDYGGWEGG<u>HATFYGGGDASGTMGGACGYGNLYSQGYG</u>
TNTAALSTALFNNGLSCGACYEMRCNDDPRWCLPGTIMVTATNFCPPNLALSNDN<u>GGWCN</u>
<u>PPLQHFDMAEPAFLQIAQYKAGIVPVSFRRVPCVKK</u>GGVRFTINGHSYFNLVLITNVGGAGD
VHSVSIKGSRTGWQAMSRNWG<u>QNWQSNAYMNGQALSFQVTTSDGRTVTSYNAAPANWQ</u>
FGQTFEGSQF

Figure 218: Amino Acid sequence of 452. The conserved pollen allergen/expansin family C-terminal domain is underlined.

MAVVGLLLVGCLAMWVCSVDGYGGGGWINAHATFYGGSDASGTMGGACGYGNLYSQGY
GTNTAALSTALFNNGLSCGSCYEIRCVNDRQWCLPASIVVTATNFCPPNNALPSNAGGWCN
PPLQHFDLSEPVFEHIARYRAGIVPVAYRRVPCRRRGG<u>IRFTINGHSYFNLVLITNVGGAGDV
HAVSVKGSRTGWMSMSRNWGQNWQSNNYLNGQSLSFKVTTSDGRSVMSYNAAPAHWSF
GQTFSGVQFR</u>

Figure 219: Amino Acid sequence of 453. The conserved pollen allergen/expansin C-terminal domain is underlined MAVVGLLLVGCLAMWVCSVDGYGGGGWINAHATFYGGSDASGTMGGACGYGNLYSQGY
GTNTAALSTALFNNGLSCGSCYEIRCVNDRQWCLPASIVVTATNFCPPNNALPSNAGGWCN
PPLQHFDLSEPVFEHIARYRAGIVPVAYRRYVHCNARPSFFGRVKKLGACVKHMNSLVRLVN
LQCPVWGTFCRVPCRRRGG<u>IRFTINGHSYFNLVLITNVGGAGDVHAVSVKGSRTGWMSMS
RNWGQNWQSNNYLNGQSLSFKVTTSDGRSVMSYNAAPAHWSFGQTFSGAQFR</u>

Figure 220: Amino Acid sequence of 454. The conserved Expansin/Lol pl family domain is underlined.

MALLLCFLLSLFISSATACDRCVHQSKAAYFSKASALSSGACGYGSLAVGLNSGFLAAAIPSL
YKDGAGCGACFQIRCKNANLCTKGGTRVIVTDLNRNNNTDFVLSSRAFAAMARQGMSQDIL
RQGIVDVEYKRVPCDYKDRN<u>LAVRVEESSRKPNYLAIKVLYQGGQTEIVAMDVAQVGSSYW
TYMSRNHGAVWNTSRVPDGALQFRFVVTPGYDGKWIWAKSVLPADWQNGVVYDSGVQIT</u>
DIAQEGCSQCDDGSW

Figure 221: Amino Acid sequence of 455. The conserved pollen allergen/expansin C-terminal domain is underlined MALLQSPSICFPLALLLALLINSSHCFNPKSLNISKVQSNGDWSPAGATWYGSPNGAGSDGG
ACGYGSGVDQAPFSSMVSAGGPSLFKSGKGCGACYQVKCTENAACSGNPVTVVITDECPG
GPCVAESAHFDLSGTAFGAMASSGKADELRNAGVLQIQYQKVKCNFPGAK<u>VAFHVDSGSN
PNYFAALIEYEDGDGELGAVNLKQALDSDSWLPMQQSWGAVWKLDGAGQLRAPFSIKLTSL
DSGKTLVANNVIPAGWQPGQTYRSVVNFAV</u>

Figure 222: Amino Acid sequence of 458. The conserved expansin domain region is in bold, and the conserved pollen allergen/expansin family C-terminal domain is underlined.

MVPLGFLVVGLLSQFVPVSRAYGYYGGWTNAHATFYGGSDASGTMGGACGYGNLYSQGY
GTNTAALSTALFNNGLSCGACFELRCVNDPQWCLPGAIVVTATNFCPPGGWCDPPQLHFD
LSQPVFQHIAQYRAGIVPVAYRRVRCRRSGG<u>IRFTVNGHSYFNLVLITNVGGAGDVHSVAIK
GSRTRWQPMSRNWGQNWQSNSDLNGQSLSFLVTASDGRSVVSYNVAPSGWSFGQTYTG
GQFRY</u>

Figure 223: Amino Acid sequence of 459. The conserved Glycoside hydrolase, family 18, domain is underlined.

MASKSSTSPAFLFSMILALVVGING<u>GGIAIYWGQNGNEGTLAEACASGNYKFVNLAFLNVFG
NGQTPMINVAGHCDPSSGGCTGLSSEIKSCQARGVKVMLSIGGGVGSYYLPSAEDARYVAT
YLWDNFLGGQSSSRPLGDAVLDGIDFVIATGTNQHWDDLARYLSAYSISGKKVYLAAAPQCP
YPDAWVGGALQTGLYDYVWVQFYGNPPCEYSSGNMGNLEDAWNQWTSIPAGEIFLGLPAS
ADASSGFIPASNLTSIVLPTIKGSAKYGGVMLWSRTVFPSSRASGHDSHVYARDGFPDSPIR</u>
RFPIRRFSVSIQLGYVMIVDGSSSQLLLKRRRLAIPDPMEAEPAKVLSLSLSHSIFSMLMLGL

Figure 224: Amino Acid sequence of 460. The conserved glycoside hydrolase, family 18, domain is underlined and the chitinases family 18 active site is in bold.

MPSPPPSKPSLSLLLLLFSSSLIRASHG<u>GGIAIYWGQNGNEGTLASTCATGKYAYVNLAFLYK
FGGGQTPQINLAGHCDPTSGGCTSTSNGIRSCQNQGIKVMLSLGGGVGSYSLASQADARNV
ANYLWNNFLGGTSSSRPLGDAVLDGIDFDIELGSTKYWDDLARYLSDYSKQGKKVYLTAAP
QCPYPDSHMGAALNTGLFDYVWVQFYNNPPCQYSSGDISKLTSSWSKWVASINAGKMFVG
LPASTEAAGSGYVPPNVLTSQILPVIKKSAKYGGIMLWSKYYDDKNGYSDSVKSSV</u>

WOOD AND CELL WALL GENE MICROARRAY

FIELD OF INVENTION

The present invention relates to polynucleotide sequences isolated from plants that encode wood and cell wall proteins. In particular, this invention relates to polynucleotide and polypeptide sequences isolated from *Eucalyptus* and *Pinus* and the use of such sequences for regulating cell wall biosynthesis and wood development.

BACKGROUND OF THE INVENTION

Plant cells, unlike animal cells, are surrounded by a relatively thin but mechanically strong cell wall. The plant cell wall is essential for many processes in plant physiology and plant development. Because of its tough outer coating, the plant cell wall provides a cellular exoskeleton that controls cell shape and allows a high turgor pressure.

Plant cell walls are composed of a complex mixture of polysaccharides and other polymers that are organized into a network linked by covalent and noncovalent bonds. Plant cell walls also contain structural proteins, enzymes, phenolic compounds, and other materials that can modify the wall's chemical and physical structure. While the appearance and architecture of cell walls varies greatly among different cell types, cell walls are commonly classified into two major types: primary walls and secondary walls.

Primary cell walls are formed by growing cells and are generally unspecialized. Primary cell walls have a similar structure and composition that is present throughout diverse cell types; generally, primary walls are composed of approximately 25% cellulose, 25% hemicellulose, 35% pectin, and about 10% structural protein. In the primary cell wall, cellulose microfibrils, which contribute to the wall's strength, are embedded in a matrix. The individual cellulose chains that comprise the microfibril are closely aligned and form a crystalline structure that is relatively inaccessible to enzymatic digestion. Thus, cellulose is very stable and only degrades during specific developmental stages, such as abscission and senescence. The cell wall matrix is composed of two polysaccharide types, hemicellulose and pectin, along with a small concentration of structural proteins. The matrix is generally well-hydrated, and the matrix hydration state determines the physical properties of the wall.

Secondary cell walls form after cessation of cell growth and enlargement. Unlike primary cell walls, secondary cell walls can adopt highly specialized structures and compositions. For example, xylem cells, such as those found in wood, have thickened secondary walls that are strengthened by lignin.

Recently, several plant cell wall proteins have been identified. For example, polynucleotide sequences encoding the following plant cell wall proteins have been identified: α-amylase, Arabinogalactan, Brassinosteroid-regulated Protein Precursor, β-1,3-endoglucanase, β-1,3-glucanase, β-D-glucan exohydrolase, β-glucosidase, β-xylosidase, Calnexin, Calreticulin, Cellulase, Cellulose synthase, Chitinase, Dirigent, Expansin, Extensin, Galacturan 1,4-α-galacturonidase, Glucose-1-phosphate adenyltransferase, Glycosyl transferase, Glycosyl hydrolase, Glycoside hydrolase, Hexose pyrophoshorylase, Hydroxyproline-rich proteins, Mannose-6-Phosphate Isomerase, Mannose-1-Phosphate Guanylyltransferase, Nucleotidyl transferase, Pectins, Pectin Methylesterase, Phosphomannomutase, Plant disease resistance response protein, Polygalacturonase, Pollen allergen/expansin, Starch Branching Enzyme, Starch Synthase, Sucrose-phosphate synthase, Sucrose synthase, Syringolide-induced protein, UTP-glucose-1-phosphate uridylyltransferase, Xyloglucan endotransglycosylase, Xyloglucan synthase, Xyloglucan: xyloglucosyl transferase, and Yieldin.

While much is known about the structure and metabolic regulation of various cell wall proteins, very little is known about their functions and intercellular interactions. Additionally, the multigenic control of a plant phenotype presents difficulties in determining the genes responsible for a given phenotype. One major obstacle to identifying genes and gene expression differences that contribute to phenotype in plants is the difficulty with which the expression of more than a handful of genes can be studied concurrently. Another difficulty in identifying and understanding gene expression and the interrelationship of the genes that contribute to plant phenotype is the high degree of sensitivity to environmental factors that plants demonstrate.

There have been recent advances using genome-wide expression profiling. In particular, the use of DNA microarrays has been useful to examine the expression of a large number of genes in a single experiment. Several studies of plant gene responses to developmental and environmental stimuli have been conducted using expression profiling. For example, microarray analysis was employed to study gene expression during fruit ripening in strawberry, Aharoni et al., *Plant Physiol.* 129:1019-1031 (2002), wound response in *Arabidopsis*, Cheong et al., *Plant Physiol.* 129:661-7 (2002), pathogen response in *Arabidopsis*, Schenk et al., *Proc. Nat'l Acad. Sci.* 97:11655-60 (2000), and auxin response in soybean, Thibaud-Nissen et al., *Plant Physiol.* 132:118. Whetten et al., *Plant Mol. Biol.* 47:275-91 (2001) discloses expression profiling of cell wall biosynthetic genes in *Pinus taeda* L. using cDNA probes. Whetten et al. examined genes which were differentially expressed between differentiating juvenile and mature secondary xylem. Additionally, to determine the effect of certain environmental stimuli on gene expression, gene expression in compression wood was compared to normal wood. A total of 156 of the 2300 elements examined showed differential expression. Whetten, supra at 285. Comparison of juvenile wood to mature wood showed 188 elements as differentially expressed. Id. at 286.

Although expression profiling and, in particular, DNA microarrays provide a convenient tool for genome-wide expression analysis, their use has been limited to organisms for which the complete genome sequence or a large cDNA collection is available. See Hertzberg et al., *Proc. Nat'l Acad. Sci.* 98:14732-7 (2001a), Hertzberg et al., *Plant J.*, 25:585 (2001b). For example, Whetten, supra, states, "A more complete analysis of this interesting question awaits the completion of a larger set of both pine and poplar ESTs." Whetten et al. at 286. Furthermore, microarrays comprising cDNA or EST probes may not be able to distinguish genes of the same family because of sequence similarities among the genes. That is, cDNAs or ESTs, when used as microarray probes, may bind to more than one gene of the same family.

Methods of manipulating gene expression to yield a plant with a more desirable phenotype would be facilitated by a better understanding of cell wall gene expression in various types of plant tissue, at different stages of plant development, and upon stimulation by different environmental cues. The ability to control plant architecture and agronomically important traits would be improved by a better understanding of how cell wall development effects plant cell development and morphology.

Accordingly, there exists a need for efficiently identifying genes that regulate plant cell wall synthesis and development.

SUMMARY OF THE INVENTION

In one embodiment, the current invention is to an isolated polynucleotide comprising a nucleic acid sequence that encodes a polypeptide that regulates cell wall development. In other embodiments, the isolated polynucleotide functions in a plant cell or the isolated polynucleotide comprises a nucleic acid sequence selected from the group consisting of SEQ ID NO: 1-230. For SEQ ID NO: 1-230, the polynucleotide is normally expressed in a species of *Eucalyptus* or *Pinus*. In other embodiments, the *Eucalyptus* in *Eucalyptus grandis* and the *Pinus* is *Pinus radiata*.

In other embodiments, the polynucleotide of the current invention is normally expressed in a species of conifer. In other embodiments, the conifer may be selected from the group consisting of Eastern white pine, Western white, Sugar pine, Red pine, Pitch pine, Jack pine, Longleaf pine, Shortleaf pine, Loblolly pine, Slash pine, Virginia pine, Ponderosa pine, Jeffrey pine, and Lodgepole pine, Radiata pine and hybrid crosses thereof. In other embodiments, the conifer is selected from the group consisting of *Abies firma, Cedrus deodara, Cedrus deodara* 'Albospica', *Cedrus deodara* 'Aurea', *Cedrus deodara* 'Kashmir', *Cedrus deodara* 'Shalimar', *Cedrus deodara* 'Silver Mist', *Cedrus deodara* 'White Imp', *Cedrus libani* (ssp. *atlantica*) *glauca, Cedrus libani* (ssp. *atlantica*) *glauca pendula, Cedrus libani* 'Nana', *Cedrus libani pendula, Cedrus libani brevifolia, Cedrus libani* var. *stenacoma, Chamaecyparis lawsoniana, Chamaecyparis nootkatensis* 'Pendula', *Chamaecyparis obtusa* 'Crippsii', *Chamaecyparis pisifera* 'Boulevard', *Chamaecyparis pisifera* 'Filifera Aurea', *Chamaecyparis thyoides* 'Blue Sport', *Cryptomeria japonica* 'Sekkan Sugi', *Cryptomeria japonica* 'Vilmoriniana', *Cunninghamia lanceolata* 'Glauca', *Cuppressus arizonica* var. *glabra* 'Blue Ice', *Cuppressus arizonica* 'Blue Sapphire', *Ginkgo biloba, Ginkgo biloba* 'Autumn Gold', *Glyptostrobus pensilis, Juniperus chinensis* 'Torulosa', *Juniperus scopulorum* 'Tollesons', *Juniperus virginiana, Larix kaempferi, Metasequoia glyptostroboides, Picea abies, Picea abies* Pendula, *Picea abies* 'Remontii', *Picea glauca* 'Sanders Blue', *Pinus×hakkodensis, Pinus nigra* var. *nigra, Picea omorika, Pinus densiflora* 'Umbraculifera', *Pinus elliottii, Pinus flexilis* 'Vanderwolf Pyramid', *Pinus pinea, Pinus massoniana, Pinus strobus, Pinus strobus* 'Pendula', *Pinus sylvestris* 'French Blue', *Pinus sylvestris* 'Mitsch Weeping', *Pinus taeda, Pinus radiata, Pinus Pinascer, Pinus thunbergiana, Pinus virginiana, Pseudotsuga menziesii, Pseudolarix amabilis, Sequoia sempervirens, Taxodium, ascendens, Taxodium distichum, Thuja occidentalis* 'Filiformis', *Tsuga Canadensis* 'Golden Splendor', ×*Cuppressocyparis leylandii*, ×*Cuppressocyparis leylandii* 'Post Sentinal', ×*Cuppressocyparis leylandii* 'Caslewellan', ×*Cuppressocyparis leylandii* 'Naylors Blue', and hybrid crosses thereof.

In another embodiment of the current invention, the conifer is a Southern Yellow pine tree. In further embodiments, the Southern Yellow pine is selected from the group consisting of *Pinus taeda, Pinus serotina, Pinus palustris*, and *Pinus elliottii* and hybrids.

In other embodiments, the isolated polynucleotide of the current invention is normally expressed in a tree selected from the group consisting of chestnut, ash, beech, basswood, birch, black cherry, black walnut/butternut, chinkapin, cottonwood, elm, eucalyptus, hackberry, hickory, holly, locust, magnolia, maple, oak, poplar, acacia, aspen, teak, red alder, royal paulownia, sassafras, sweetgum, sycamore, tupelo, willow, and yellow-poplar, and intra- and inter-species hybrid crosses thereof.

In other embodiments, the isolated polynucleotide of the current invention is normally expressed in a gymnosperm or an angiosperm.

In other embodiments, the isolated polynucleotide of the current invention expresses a polypeptide that is capable of regulating cell wall synthesis in a monocotyledenous plant. In further embodiments, monocotyledenous plant is selected from the group consisting of turfgrass, wheat, maize, rice, oat, barley, orchid, iris, lily, onion, sugarcane, and sorghum. In other embodiments, the turfgrass is selected from the group consisting of *Agrostis* spp., *Poa pratensis, Lolium* spp., Kentucky Bluegrass And Perennial Ryegrass Mix; *Festuca arundinacea, Festuca rubra commutata, Cynodon dactylon, Pennisetum clandestinum, Stenotaphrum secundatum, Zoysia japonica*, and *Dichondra micrantha*.

In other embodiments, the isolated polynucleotide of the current invention expresses a polypeptide that is capable of regulating cell wall synthesis in a dicotyledenous plant. In further embodiments, the dicotyledenous plant is selected from the group consisting of cotton, tobacco, *Arabidopsis*, tomato, potato, aspen, eucalyptus, Sweetgum, acacia, poplar, willow, teak, mahogany, chestnut, elm, sugar beet, broccoli, cassava, sweet potato, pepper, poinsettia, legumes, alfalfa, soybean, carrot, strawberry, lettuce, oak, maple, walnut, rose, mint, squash, daisy, geranium and cactus.

In other embodiments, the isolated polynucleotide of the current invention is capable of upregulating or downregulating cell wall biosynthesis in a plant. In further embodiments, the polynucleotide is from a gene that is endogenous to the plant genome. In other embodiments, the phenotype of a plant which expresses the isolated polynucleotide in at least one cell, is different from the phenotype of a plant of the same species that does not express the isolated polynucleotide in any of its cells. In other embodiments, the phenotype of the plant expressing the isolated polynucleotide comprises a difference in lignin quality compared to a plant of the same species that does not express the isolated polynucleotide. In other embodiments, the difference in lignin quality is characterized by change in the structure of the lignin molecule. In other embodiments, the phenotype of the plant expressing the isolated polynucleotide comprises a difference in wood composition compared to a plant of the same species that does not express the isolated polynucleotide. In other embodiments, the phenotype of the plant expressing the isolated polynucleotide comprises a difference in fiber composition compared to a plant of the same species that does not express the isolated polynucleotide. In other embodiments, the phenotype of the plant expressing the isolated polynucleotide comprises a difference in plant cell division compared to a plant of the same species that does not express the isolated polynucleotide. In other embodiments, the phenotype of the plant expressing the isolated polynucleotide comprises a difference in plant cell development compared to a plant of the same species that does not express the isolated polynucleotide. In other embodiments, the phenotype of the plant expressing the isolated polynucleotide comprises a difference in height, volume, or yield compared to a plant of the same species that does not express the isolated polynucleotide.

In other embodiments, the isolated polynucleotide of the current invention, comprises the sequence of any one of SEQ ID NOs: 1-230, or variant thereof. In other embodiments, the variant encodes a polypeptide that is capable of regulating cell wall development in a plant. In other embodiments, the variant has a sequence identity that is greater than or equal to 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, 75%, 74%, 73%, 72%, 71%, 70%, 69%, 68%, 67%, 66%, 65%, 64%, 63%, 62%, 61%, or 60% in sequence to any one of SEQ ID NOs: 1-230.

In other embodiments, the plant cell wall protein of the current invention, comprises the amino acid sequence of any one of SEQ ID NOs: 1-230, or variant thereof, wherein said cell wall protein is capable of regulating cell wall development in a plant. In other embodiments, the variant has a sequence identity that is greater than or equal to 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, 75%, 74%, 73%, 72%, 71%, 70%, 69%, 68%, 67%, 66%, 65%, 64%, 63%, 62%, 61%, or 60% in sequence to any one of SEQ ID NOs: 1-230.

In other embodiments, a DNA construct of the current invention comprises (i) at least one polynucleotide that has the sequence of any one of SEQ ID NOs: 1-230, and (ii) a promoter, wherein said promoter and said polynucleotide are operably linked. In other embodiments, the promoter is selected from the group consisting of a constitutive promoter, a strong promoter, or an inducible promoter. In other embodiments, the inducible promoter is regulated by any one of wounding, methyl jasmonate or salicylic acid. In other embodiments, the polynucleotide produces an RNA transcript. In other embodiments, RNA transcript has an antisense sequence of a gene that is endogenous to a plant cell or the RNA transcript induces RNA interference of a gene that is normally expressed in a plant cell.

In another embodiment, a plant cell of the current invention comprises a DNA construct that comprises (i) at least one polynucleotide that has the sequence of any one of SEQ ID NOs: 1-230 and (ii) a promoter, wherein said polynucleotide encodes a protein that regulates cell wall development, and wherein said promoter and said polynucleotide are operably linked. In another embodiment the current invention is to a transgenic plant comprising such a plant cell.

In other embodiments, a plant cell of the current invention comprises a DNA construct that comprises (i) at least one polynucleotide that has the sequence of any one of SEQ ID NOs: 1-230 and (ii) a promoter, wherein said polynucleotide encodes a protein that regulates wood development, and wherein said promoter and said polynucleotide are operably linked. In another embodiment the current invention is to a transgenic plant comprising such a plant cell.

In other embodiments, the current invention is to a method for producing a transgenic plant, comprising (a) transforming a plant cell with a DNA construct that comprises (i) at least one polynucleotide that has the sequence of any one of SEQ ID NOs: 1-230 and (ii) a promoter, wherein said polynucleotide encodes a protein that regulates cell wall development; (b) culturing said transformed plant cell under conditions that promote growth of a plant, and (c) selecting a transgenic plant that exhibits a phenotype that is different from a plant of the same species that does not contain said DNA construct. In other embodiments, the phenotype of the plant expressing the polynucleotide and the desired nucleic acid is characterized by a difference in lignin quality compared to a plant of the same species that does not contain the DNA construct. In other embodiments, the difference in lignin quality is characterized by change in the structure of the lignin molecule. In other embodiments of the current method, the phenotype of the plant expressing the polynucleotide and the desired nucleic acid is characterized by a difference in wood composition compared to a plant of the same species that does not contain the DNA construct. In other embodiments of the current method, the phenotype of the plant expressing the polynucleotide is characterized by a difference in fiber yield compared to a plant of the same species that does not contain the DNA construct. In other embodiments of the current method, the method of claim 44, wherein the phenotype of the plant expressing the polynucleotide is characterized by a difference in plant cell division compared to a plant of the same species that does not contain the DNA construct. In other embodiments of the current method, the phenotype of the plant expressing the polynucleotide is characterized by a difference in plant cell development compared to a plant of the same species that does not contain the DNA construct. In other embodiments, the phenotype of the plant expressing the polynucleotide is characterized by a difference in starch synthesis compared to a plant of the same species that does not contain the DNA construct. In other embodiments, the phenotype of the plant expressing the polynucleotide and the desired nucleic acid is characterized by a difference in height, volume, or yield, compared to a plant of the same species that does not contain the DNA construct.

In another embodiment, the current invention is to wood pulp obtained from a transgenic tree expressing a polypeptide comprising an amino acid sequence of any one of SEQ ID NOs. 1-230.

In another embodiment, transgenic plant of the current invention expresses a polypeptide comprising an amino acid sequence of any one of SEQ ID NOs: 1-230, wherein said amino acid confers a trait to the plant selected from the group consisting of increased drought tolerance, reduced or increased height, reduced or increased volume, reduced or increased branching, enhanced cold and frost tolerance, improved vigor, enhanced color, enhanced health and nutritional characteristics, improved storage, enhanced yield, enhanced salt tolerance, enhanced heavy metal tolerance, increased disease tolerance, increased insect tolerance, increased water-stress tolerance, enhanced sweetness, improved taste, improved texture, decreased phosphate content, increased germination, increased micronutrient uptake, improved starch composition, improved flower longevity, and production of novel proteins or peptides.

In other embodiments, the current invention is to a transgenic plant expressing a polypeptide comprising the amino acid sequence of any one of SEQ ID NOs: 1-230, wherein said plant has a reduced or increased period of juvenality compared to a wild-type plant of the same species.

In other embodiments, the current invention is to a transgenic plant expressing a polypeptide comprising the amino acid sequence of any one of SEQ ID NOs: 1-230, wherein said plant has self-absicing branches.

In other embodiments, the current invention is to an isolated nucleotide sequence having the nucleotide sequence of any of SEQ ID NO: 1-230, and nucleotide sequences having 60% sequence identity with the nucleotide sequence of SEQ ID NO: 1-230 and which are capable of regulating plant cell wall development.

In other embodiments, the current invention is to an isolated nucleotide sequence having the nucleotide sequence of any of SEQ ID NO: 1-230, and nucleotide sequences having 65% sequence identity with any of the nucleotide sequences of SEQ ID NO: 1-230 and which are involved in wood development.

In other embodiments, the current invention is to an isolated nucleotide sequence having the nucleotide sequence of any of SEQ ID NO: 1-230 and nucleotide sequences having 70% sequence identity with any of the nucleotide sequences of SEQ ID NO: 1-230 and which regulate cell wall biogenesis.

In other embodiments, the current invention is to a method of correlating polynucleotide expression in two different samples, comprising:

detecting a level of expression of one or more polynucleotides encoding a product encoded by a nucleic acid sequence selected from the group, consisting of SEQ ID NOs: 1-230 and conservative variants thereof in a first sample;

detecting a level of expression of the one or more polynucleotides in a second sample;

comparing the level of expression of the one or more polynucleotides in the first sample to the level of expression of the one or more polynucleotides in the second sample; and correlating a difference in expression level of the one or more polynucleotides between the first and second samples. In other embodiments, the first sample and the second sample are each from a different type of plant tissue. In other embodiments, the first sample and the second sample are from the same tissue, and wherein the first sample and the second sample are each harvested during a different season of the year. In other embodiments, the first sample and the second sample are obtained from plants in different stages of development.

In other embodiments, the current invention is to a method of correlating the possession of a plant phenotype to the level of polynucleotide expression in the plant of one or more polynucleotides comprising:

detecting a level of expression of one or more polynucleotides encoding a product encoded by a nucleic acid sequence selected from the group consisting of SEQ ID NOs: 1-230 and conservative variants thereof in a first plant possessing a phenotype;

detecting a level of expression of the one or more polynucleotides in a second plant lacking the phenotype;

comparing the level of expression of the one or more polynucleotides in the first plant to the level of expression of the one or more polynucleotides in the second plant; and correlating a difference in expression level of the one or more polynucleotides between the first and second plants to possession of the phenotype. In other embodiments, the first and second samples are both obtained from a plant tissue selected from the group consisting of vascular tissue, apical meristem, vascular cambium, xylem, phloem, root, flower, cone, fruit, and seed. In other embodiments, the plant tissue of the first sample and second sample are each obtained from a different type of tissue. In other embodiments, the first and second samples are each obtained from a plant tissue in a different stage of development. In other embodiments, both the first and second plants or plant cells are of a same species selected from *Eucalyptus* and *Pinus* species. In other embodiments, the first and second plants or plant cells are of a species selected from *Eucalyptus grandis* or *Pinus radiata*. In other embodiments, the step of detecting is effected using one or more polynucleotides capable of hybridizing to a nucleic acid sequence selected from the group consisting of SEQ ID NOs: 1-230 under standard hybridization conditions. In other embodiments, the step of detecting is effected using one or more polynucleotides capable of hybridizing to a polynucleotide expression product encoded by a nucleic acid sequence selected from the group consisting of SEQ ID NOs: 1-230 under standard hybridization conditions. In other embodiments, the step of detecting is affected by hybridization to a labeled nucleic acid. In other embodiments, the one or more polynucleotides are labeled with a detectable label. In other embodiments, at least one of the one or more polynucleotides hybridizes to a 3' untranslated region of one of the one or more polynucleotides. In other embodiments, at least one of the one or more polynucleotides hybridizes to the 3' untranslated region of one of the one or more polynucleotides. In other embodiments, the one or more polynucleotides comprises a nucleic acid sequence selected from the group consisting of SEQ ID NOs: 1-230. In other embodiments, the one or more polynucleotides comprises a nucleic acid sequence selected from the group consisting of SEQ ID NOs: 1-230. In other embodiments, the one or more polynucleotides is selected from the group consisting of DNA and RNA. In other embodiments, prior to the detecting steps, the step of amplifying the one or more polynucleotides in the first and second plant or plant cells is provided. In other embodiments, prior to the detecting steps, the step of labeling the one or more polynucleotides in the first and second plant or plant cells with a detectable label is provided.

In other embodiments, the current invention is to a combination for detecting expression of one or more polynucleotides, comprising two or more oligonucleotides, wherein each oligonucleotide is capable of hybridizing to a nucleic acid sequence selected from the group consisting of SEQ ID NOs: 461-690. In other embodiments, the two or more oligonucleotides hybridizes to a different one of the nucleic acid sequences selected from the group consisting of SEQ ID NOs: 1-230. In other embodiments, at least one of the two or more oligonucleotides hybridizes to a 3' untranslated region of a nucleic acid sequence selected from the group consisting of SEQ ID NOs: 1-230. In other embodiments, each of the two or more oligonucleotides are comprised of fewer than about 100 nucleotide bases. In other embodiments, at least one of the two or more oligonucleotides comprises a nucleic acid sequence selected from the group consisting of SEQ ID NOs: 461-690. In other embodiments, each of the two or more oligonucleotides hybridizes to a gene encoding a protein selected from the group consisting of α-amylase, Arabinogalactan, Calnexin, Calreticulin; Cellulose synthase, Dirigent, Expansin, Extensin, Galacturan 1,4-β-galacturonidase, Glucose-1-phosphate adenyltransferase, Glycosyl transferase, Glycosyl hydrolase, Glycoside hydrolase, Hydroxyproline-rich proteins, Mannose-6-Phosphate Isomerase, Mannose-1-Phosphate Guanylyltransferase, Nucleotidyl transferase, Pectins, Pectin Methylesterase, Phosphomannomutase, Plant disease resistance response protein, Polygalacturonase, Pollen allergen/expansin, Starch Branching Enzyme, Starch Synthase, Sucrose-phosphate synthase, Sucrose synthase, UTP-glucose-1-phosphate uridylyltransferase, Xyloglucan synthase, Xyloglucan: xyloglucosyl transferase, and Yieldin. In other embodiments, each of the two or more oligonucleotides hybridizes to a gene encoding a different one of the proteins. In other embodiments, each of the two or more oligonucleotides hybridizes to a different gene. In other embodiments, the combination comprises from about 2 to about 5000 of the two or more oligonucleotides. In other embodiments, each of the two or more oligonucleotides is labeled with a detectable label.

In other embodiments, the current invention is to a combination for detecting expression of one or more polynucleotides, comprising two or more oligonucleotides, wherein each oligonucleotide is capable of hybridizing to a polynucleotide expression product encoded by a nucleic acid sequence selected from the group consisting of SEQ ID NOs: 1-230. In other embodiments, the two or more oligonucleotides hybridizes to a nucleotide sequence encoded by a different one of the nucleic acid sequences selected from the group consisting of SEQ ID NOs: 1-230. In other embodiments, at least one of the two or more oligonucleotides hybridizes to nucleic acid sequence that is complementary to a 3' untranslated region of a nucleic acid sequence selected from the group consisting of SEQ ID NOs: 1-230. In other embodiments, each of the two or more oligonucleotides are comprised of fewer than about 100 nucleotide bases. In other embodiments, at least one of the two or more oligonucleotides comprises a nucleic acid sequence selected from the group consisting of SEQ ID NOs: 461-690. In other embodiments, each of the two or more oligonucleotides hybridizes to a nucleic acid sequence encoded by a gene encoding a protein selected from the group consisting of α-amylase, Arabinogalactan, Calnexin, Calreticulin, Cellulose synthase, Dirigent, Expansin, Extensin, Galacturan 1,4-β-galacturonidase, Glucose-1-phosphate adenyltransferase, Glycosyl transferase, Glycosyl hydrolase, Glycoside hydrolase, Hydroxyproline-rich proteins, Mannose-6 Phosphate Isomerase, Mannose-1-Phosphate Guanylyltransferase, Nucleotidyl transferase, Pectins, Pectin Methylesterase, Phosphomannomutase, Plant disease resistance response protein, Polygalacturonase, Pollen allergen/expansin, Starch Branching Enzyme, Starch Synthase, Sucrose-phosphate synthase, Sucrose synthase, UTP-glucose-1-phosphate uridylyltransferase, Xyloglucan synthase, Xyloglucan: xyloglucosyl transferase, and Yieldin. In other embodiments, each of the two or more oligonucleotides hybridizes to a nucleic acid sequence encoded by a gene encoding a different one of the proteins. In other embodiments, each of the two or more oligonucleotides hybridizes to a nucleic acid sequence encoded by a different gene. In other embodiments, the combination comprises from about 2 to about 5000 of the two or more oligonucleotides. In other embodiments, each of the two or more oligonucleotides is labeled with a detectable label.

In other embodiments, the current invention is to a microarray comprising the above combination provided on a solid support, wherein each of said two or more oligonucleotides occupies a unique location on said solid support. In other embodiments, the current invention is to a kit for detecting gene expression comprising the above microarray together with one or more buffers or reagents for a nucleotide hybridization reaction.

In other embodiments, the current invention is to a method for detecting one or more polynucleotides in a sample, comprising:

contacting the sample with two or more oligonucleotides, wherein each oligonucleotide is capable of hybridizing to a gene comprising a nucleic acid sequence selected from the group consisting of SEQ ID NOs: 1-230 under standard hybridization conditions; and detecting the one or more polynucleotides of interest which are hybridized to the one or more oligonucleotides. In other embodiments, each of the two or more oligonucleotides hybridizes to a gene comprising a different one of the nucleic acid sequences selected from the group consisting of SEQ ID NOs: 1-230. In other embodiments, at least one of the two or more oligonucleotides hybridizes to a 3' untranslated region of a gene comprising a nucleic acid sequence selected from the group consisting of SEQ ID NOs 1-230. In other embodiments, each of the two or more oligonucleotides are comprised of fewer than about 100 nucleotide bases. In other embodiments, at least one of the two or more oligonucleotides comprises a nucleic acid sequence selected from the group consisting of SEQ ID NOs 461-690. In other embodiments, each of the two or more oligonucleotides hybridizes to a gene encoding a protein selected from the group consisting of α-amylase, Arabinogalactan, Calnexin, Calreticulin, Cellulose synthase, Dirigent, Expansin, Extensin, Galacturan 1,4-β-galacturonidase, Glucose-1-phosphate adenyltransferase, Glycosyl transferase, Glycosyl hydrolase, Glycoside hydrolase, Hydroxyproline-rich proteins, Mannose-6-Phosphate Isomerase, Mannose-1-Phosphate Guanylyltransferase, Nucleotidyl transferase, Pectins, Pectin Methylesterase, Phosphomannomutase, Plant disease resistance response protein, Polygalacturonase, Pollen allergen/expansin, Starch Branching Enzyme, Starch Synthase, Sucrose-phosphate synthase, Sucrose synthase, UTP-glucose-1-phosphate uridylyltransferase, Xyloglucan synthase, Xyloglucan: xyloglucosyl transferase, and Yieldin. In other embodiments, each of the two or more oligonucleotides hybridizes to a gene encoding a different one of the proteins. In another embodiment, the two or more oligonucleotides are provided on a solid support, wherein each of the two of more oligonucleotides occupy a unique location on the solid support. In other embodiments, the solid support comprises from about 2 to about 5000 of the two or more oligonucleotides. In other embodiments, the current method further comprises, prior to the contacting step, the step of amplifying the one or more polynucleotides or nucleic acid sequences in the sample. In other embodiments, the current method further comprises prior to the contacting step, the step of labeling the one or more polynucleotides or nucleic acid sequences in the sample with a detectable label.

In other embodiments, the current invention is to a method for detecting one or more nucleic acid sequences encoded by one or more polynucleotides in a sample, comprising:

contacting the sample with two or more oligonucleotides, wherein each oligonucleotide is capable of hybridizing to a nucleic acid sequence encoded by a gene comprising a nucleic acid sequence selected from the group consisting of SEQ ID NOs: 1-230 under standard hybridization conditions; and detecting the one or more nucleic acid sequences which are hybridized to the one or more oligonucleotides. In other embodiments, each of the two or more oligonucleotides hybridizes to a nucleic acid sequence encoded by a gene comprising a different one of the nucleic acid sequences selected from the group consisting of SEQ ID NOs: 1-230. In other embodiments, at least one of the two or more oligonucleotides hybridizes to a nucleic acid sequence that is complementary to a 3' untranslated region of a gene comprising a nucleic acid sequence selected from the group consisting of SEQ ID NOs: 1-230. In other embodiments, each of the two or more oligonucleotides are comprised of fewer than about 100 nucleotide bases. In other embodiments, at least one of the two or more oligonucleotides comprises a nucleic acid sequence selected from the group consisting of SEQ ID NOs: 461-690. In other embodiments, each of the two or more oligonucleotides hybridizes to a nucleic acid sequence encoded by a gene encoding a protein selected from the group consisting of α-amylase, Arabinogalactan, Calnexin, Calreticulin, Cellulose synthase, Dirigent, Expansin, Extensin, Galacturan 1,4-β-galacturonidase, Glucose-1-phosphate adenyltransferase, Glycosyl transferase, Glycosyl hydrolase, Glycoside hydrolase, Hydroxyproline-rich proteins, Mannose-6-Phosphate Isomerase, Mannose-1-Phosphate Guanylyltransferase, Nucleotidyl transferase, Pectins, Pectin Methylesterase, Phosphomannomutase, Plant disease resistance response protein, Polygalacturonase, Pollen allergen/expansin, Starch Branching Enzyme, Starch Synthase, Sucrose-phosphate synthase, Sucrose synthase, UTP-glucose-1-phosphate uridylyltransferase, Xyloglucan synthase, Xyloglucan: xyloglucosyl transferase, and Yieldin. In other embodiments, each of the two or more oligonucleotides hybridizes to a nucleic acid sequence encoded by a gene encoding a different one of the proteins. In another embodiment, the two or more oligonucleotides are provided on a solid support, wherein each of the two of more oligonucleotides occupy a unique location on the solid support. In other embodiments, the solid support comprises from about 2 to about 5000 of the two or more oligonucleotides. In other embodiments, the current method further comprises, prior to the contacting step, the step of amplifying the one or more polynucleotides or nucleic acid sequences in the sample. In other embodiments, the current method further comprises prior to the contacting step, the step of labeling the one or more polynucleotides or nucleic acid sequences in the sample with a detectable label.

BRIEF DESCRIPTION OF THE FIGURES

FIG. 1 shows the annotated amino acid sequence of SEQ ID NO: 231.
FIG. 2 shows the annotated amino acid sequence of SEQ ID NO: 232.
FIG. 3 shows the annotated amino acid sequence of SEQ ID NO: 234.
FIG. 4 shows the annotated amino acid sequence of SEQ ID NO: 235.
FIG. 5 shows the annotated amino acid sequence of SEQ ID NO: 236.
FIG. 6 shows the annotated amino acid sequence of SEQ ID NO: 237.
FIG. 7 shows the annotated amino acid sequence of SEQ ID NO: 238.
FIG. 8 shows the annotated amino acid sequence of SEQ ID NO: 239.
FIG. 9 shows the annotated amino acid sequence of SEQ ID NO: 240.
FIG. 10 shows the annotated amino acid sequence of SEQ ID NO: 241.
FIG. 11 shows the annotated amino acid sequence of SEQ ID NO: 242.
FIG. 12 shows the annotated amino acid sequence of SEQ ID NO: 243.
FIG. 13 shows the annotated amino acid sequence of SEQ ID NO: 244.
FIG. 14 shows the annotated amino acid sequence of SEQ ID NO: 245.
FIG. 15 shows the annotated amino acid sequence of SEQ ID NO: 246.
FIG. 16 shows the annotated amino acid sequence of SEQ ID NO: 248.
FIG. 17 shows the annotated amino acid sequence of SEQ ID NO: 249.
FIG. 18 shows the annotated amino acid sequence of SEQ ID NO: 250.
FIG. 19 shows the annotated amino acid sequence of SEQ ID NO: 251.
FIG. 20 shows the annotated amino acid sequence of SEQ ID NO: 252.
FIG. 21 shows the annotated amino acid sequence of SEQ ID NO: 253.
FIG. 22 shows the annotated amino acid sequence of SEQ ID NO: 254.
FIG. 23 shows the annotated amino acid sequence of SEQ ID NO: 255.
FIG. 24 shows the annotated amino acid sequence of SEQ ID NO: 256.
FIG. 25 shows the annotated amino acid sequence of SEQ ID NO: 257.
FIG. 26 shows the annotated amino acid sequence of SEQ ID NO: 259.
FIG. 27 shows the annotated amino acid sequence of SEQ ID NO: 260.
FIG. 28 shows the annotated amino acid sequence of SEQ ID NO: 261.
FIG. 29 shows the annotated amino acid sequence of SEQ ID NO: 262.
FIG. 30 shows the annotated amino acid sequence of SEQ ID NO: 263.
FIG. 31 shows the annotated amino acid sequence of SEQ ID NO: 264.
FIG. 32 shows the annotated amino acid sequence of SEQ ID NO: 265.
FIG. 33 shows the annotated amino acid sequence of SEQ ID NO: 266.
FIG. 34 shows the annotated amino acid sequence of SEQ ID NO: 267.
FIG. 35 shows the annotated amino acid sequence of SEQ ID NO: 268.
FIG. 36 shows the annotated amino acid sequence of SEQ ID NO: 269.
FIG. 37 shows the annotated amino acid sequence of SEQ ID NO: 270.
FIG. 38 shows the annotated amino acid sequence of SEQ ID NO: 271.
FIG. 39 shows the annotated amino acid sequence of SEQ ID NO: 272.
FIG. 40 shows the annotated amino acid sequence of SEQ ID NO: 273.
FIG. 41 shows the annotated amino acid sequence of SEQ ID NO: 274.
FIG. 42 shows the annotated amino acid sequence of SEQ ID NO: 275.
FIG. 43 shows the annotated amino acid sequence of SEQ ID NO: 276.
FIG. 44 shows the annotated amino acid sequence of SEQ ID NO: 277.
FIG. 45 shows the annotated amino acid sequence of SEQ ID NO: 278.
FIG. 46 shows the annotated amino acid sequence of SEQ ID NO: 279.
FIG. 47 shows the annotated amino acid sequence of SEQ ID NO: 280.
FIG. 48 shows the annotated amino acid sequence of SEQ ID NO: 281.
FIG. 49 shows the annotated amino acid sequence of SEQ ID NO: 282.
FIG. 50 shows the annotated amino acid sequence of SEQ ID NO: 283.
FIG. 51 shows the annotated amino acid sequence of SEQ ID NO: 284.
FIG. 52 shows the annotated amino acid sequence of SEQ ID NO: 285.
FIG. 53 shows the annotated amino acid sequence of SEQ ID NO: 286.
FIG. 54 shows the annotated amino acid sequence of SEQ ID NO: 287.
FIG. 55 shows the annotated amino acid sequence of SEQ ID NO: 288.
FIG. 56 shows the annotated amino acid sequence of SEQ ID NO: 289.
FIG. 57 shows the annotated amino acid sequence of SEQ ID NO: 290.
FIG. 58 shows the annotated amino acid sequence of SEQ ID NO: 291.
FIG. 59 shows the annotated amino acid sequence of SEQ ID NO: 292.
FIG. 60 shows the annotated amino acid sequence of SEQ ID NO: 293.
FIG. 61 shows the annotated amino acid sequence of SEQ ID NO: 294.
FIG. 62 shows the annotated amino acid sequence of SEQ ID NO: 295.

FIG. 63 shows the annotated amino acid sequence of SEQ ID NO: 296.
FIG. 64 shows the annotated amino acid sequence of SEQ ID NO: 297.
FIG. 65 shows the annotated amino acid sequence of SEQ ID NO: 298.
FIG. 66 shows the annotated amino acid sequence of SEQ ID NO: 299.
FIG. 67 shows the annotated amino acid sequence of SEQ ID NO: 300.
FIG. 68 shows the annotated amino acid sequence of SEQ ID NO: 301.
FIG. 69 shows the annotated amino acid sequence of SEQ ID NO: 302.
FIG. 70 shows the annotated amino acid sequence of SEQ ID NO: 303.
FIG. 71 shows the annotated amino acid sequence of SEQ ID NO: 304.
FIG. 72 shows the annotated amino acid sequence of SEQ ID NO: 305.
FIG. 73 shows the annotated amino acid sequence of SEQ ID NO: 306.
FIG. 74 shows the annotated amino acid sequence of SEQ ID NO: 307.
FIG. 75 shows the annotated amino acid sequence of SEQ ID NO: 308.
FIG. 76 shows the annotated amino acid sequence of SEQ ID NO: 309.
FIG. 77 shows the annotated amino acid sequence of SEQ ID NO: 310.
FIG. 78 shows the annotated amino acid sequence of SEQ ID NO: 311.
FIG. 79 shows the annotated amino acid sequence of SEQ ID NO: 312.
FIG. 80 shows the annotated amino acid sequence of SEQ ID NO: 313.
FIG. 81 shows the annotated amino acid sequence of SEQ ID NO: 314.
FIG. 82 shows the annotated amino acid sequence of SEQ ID NO: 315.
FIG. 83 shows the annotated amino acid sequence of SEQ ID NO: 316.
FIG. 84 shows the annotated amino acid sequence of SEQ ID NO: 317.
FIG. 85 shows the annotated amino acid sequence of SEQ ID NO: 318.
FIG. 86 shows the annotated amino acid sequence of SEQ ID NO: 319.
FIG. 87 shows the annotated amino acid sequence of SEQ ID NO: 320.
FIG. 87 shows the annotated amino acid sequence of SEQ ID NO: 321.
FIG. 89 shows the annotated amino acid sequence of SEQ ID NO: 322.
FIG. 90 shows the annotated amino acid sequence of SEQ ID NO: 323.
FIG. 91 shows the annotated amino acid sequence of SEQ ID NO: 324.
FIG. 92 shows the annotated amino acid sequence of SEQ ID NO: 325.
FIG. 93 shows the annotated amino acid sequence of SEQ ID NO: 326.
FIG. 94 shows the annotated amino acid sequence of SEQ ID NO: 327.
FIG. 95 shows the annotated amino acid sequence of SEQ ID NO: 328.
FIG. 96 shows the annotated amino acid sequence of SEQ ID NO: 329.
FIG. 97 shows the annotated amino acid sequence of SEQ ID NO: 330.
FIG. 98 shows the annotated amino acid sequence of SEQ ID NO: 331.
FIG. 99 shows the annotated amino acid sequence of SEQ ID NO: 332.
FIG. 100 shows the annotated amino acid sequence of SEQ ID NO: 333.
FIG. 101 shows the annotated amino acid sequence of SEQ ID NO: 334.
FIG. 102 shows the annotated amino acid sequence of SEQ ID NO: 335.
FIG. 103 shows the annotated amino acid sequence of SEQ ID NO: 336.
FIG. 104 shows the annotated amino acid sequence of SEQ ID NO: 337.
FIG. 105 shows the annotated amino acid sequence of SEQ ID NO: 338.
FIG. 106 shows the annotated amino acid sequence of SEQ ID NO: 339.
FIG. 107 shows the annotated amino acid sequence of SEQ ID NO: 340.
FIG. 108 shows the annotated amino acid sequence of SEQ ID NO: 341.
FIG. 109 shows the annotated amino acid sequence of SEQ ID NO: 342.
FIG. 110 shows the annotated amino acid sequence of SEQ ID NO: 343.
FIG. 111 shows the annotated amino acid sequence of SEQ ID NO: 344.
FIG. 112 shows the annotated amino acid sequence of SEQ ID NO: 345.
FIG. 113 shows the annotated amino acid sequence of SEQ ID NO: 346.
FIG. 114 shows the annotated amino acid sequence of SEQ ID NO: 347.
FIG. 115 shows the annotated amino acid sequence of SEQ ID NO: 348.
FIG. 116 shows the annotated amino acid sequence of SEQ ID NO: 349.
FIG. 117 shows the annotated amino acid sequence of SEQ ID NO: 350.
FIG. 118 shows the annotated amino acid sequence of SEQ ID NO: 351.
FIG. 119 shows the annotated amino acid sequence of SEQ ID NO: 352.
FIG. 120 shows the annotated amino acid sequence of SEQ ID NO: 353.
FIG. 121 shows the annotated amino acid sequence of SEQ ID NO: 354.
FIG. 122 shows the annotated amino acid sequence of SEQ ID NO: 355.
FIG. 123 shows the annotated amino acid sequence of SEQ ID NO: 356.
FIG. 124 shows the annotated amino acid sequence of SEQ ID NO: 357.
FIG. 125 shows the annotated amino acid sequence of SEQ ID NO: 358.
FIG. 126 shows the annotated amino acid sequence of SEQ ID NO: 359.
FIG. 127 shows the annotated amino acid sequence of SEQ ID NO: 360.
FIG. 128 shows the annotated amino acid sequence of SEQ ID NO: 361.

FIG. 129 shows the annotated amino acid sequence of SEQ ID NO: 362.
FIG. 130 shows the annotated amino acid sequence of SEQ ID NO: 363.
FIG. 131 shows the annotated amino acid sequence of SEQ ID NO: 364.
FIG. 132 shows the annotated amino acid sequence of SEQ ID NO: 365.
FIG. 133 shows the annotated amino acid sequence of SEQ ID NO: 366.
FIG. 134 shows the annotated amino acid sequence of SEQ ID NO: 367.
FIG. 135 shows the annotated amino acid sequence of SEQ ID NO: 368.
FIG. 136 shows the annotated amino acid sequence of SEQ ID NO: 369.
FIG. 137 shows the annotated amino acid sequence of SEQ ID NO: 370.
FIG. 138 shows the annotated amino acid sequence of SEQ ID NO: 371.
FIG. 139 shows the annotated amino acid sequence of SEQ ID NO: 372.
FIG. 140 shows the annotated amino acid sequence of SEQ ID NO: 373.
FIG. 141 shows the annotated amino acid sequence of SEQ ID NO: 374.
FIG. 142 shows the annotated amino acid sequence of SEQ ID NO: 375.
FIG. 143 shows the annotated amino acid sequence of SEQ ID NO: 376.
FIG. 144 shows the annotated amino acid sequence of SEQ ID NO: 377.
FIG. 145 shows the annotated amino acid sequence of SEQ ID NO: 378.
FIG. 146 shows the annotated amino acid sequence of SEQ ID NO: 380. family 17 signature is in bold.
FIG. 147 shows the annotated amino acid sequence of SEQ ID NO: 381.
FIG. 148 shows the annotated amino acid sequence of SEQ ID NO: 382.
FIG. 149 shows the annotated amino acid sequence of SEQ ID NO: 383.
FIG. 150 shows the annotated amino acid sequence of SEQ ID NO: 384.
FIG. 151 shows the annotated amino acid sequence of SEQ ID NO: 385.
FIG. 152 shows the annotated amino acid sequence of SEQ ID NO: 386.
FIG. 153 shows the annotated amino acid sequence of SEQ ID NO: 387.
FIG. 154 shows the annotated amino acid sequence of SEQ ID NO: 388.
FIG. 155 shows the annotated amino acid sequence of SEQ ID NO: 389.
FIG. 156 shows the annotated amino acid sequence of SEQ ID NO: 390.
FIG. 157 shows the annotated amino acid sequence of SEQ ID NO: 391.
FIG. 158 shows the annotated amino acid sequence of SEQ ID NO: 392.
FIG. 159 shows the annotated amino acid sequence of SEQ ID NO: 393.
FIG. 160 shows the annotated amino acid sequence of SEQ ID NO: 394.
FIG. 161 shows the annotated amino acid sequence of SEQ ID NO: 395.
FIG. 162 shows the annotated amino acid sequence of SEQ ID NO: 396.
FIG. 163 shows the annotated amino acid sequence of SEQ ID NO: 397.
FIG. 164 shows the annotated amino acid sequence of SEQ ID NO: 398.
FIG. 165 shows the annotated amino acid sequence of SEQ ID NO: 399.
FIG. 166 shows the annotated amino acid sequence of SEQ ID NO: 400.
FIG. 167 shows the annotated amino acid sequence of SEQ ID NO: 401.
FIG. 168 shows the annotated amino acid sequence of SEQ ID NO: 402.
FIG. 169 shows the annotated amino acid sequence of SEQ ID NO: 403.
FIG. 170 shows the annotated amino acid sequence of SEQ ID NO: 404.
FIG. 171 shows the annotated amino acid sequence of SEQ ID NO: 405.
FIG. 172 shows the annotated amino acid sequence of SEQ ID NO: 406.
FIG. 173 shows the annotated amino acid sequence of SEQ ID NO: 407.
FIG. 174 shows the annotated amino acid sequence of SEQ ID NO: 408.
FIG. 175 shows the annotated amino acid sequence of SEQ ID NO: 409.
FIG. 176 shows the annotated amino acid sequence of SEQ ID NO: 410.
FIG. 177 shows the annotated amino acid sequence of SEQ ID NO: 411.
FIG. 178 shows the annotated amino acid sequence of SEQ ID NO: 412.
FIG. 179 shows the annotated amino acid sequence of SEQ ID NO: 413.
FIG. 180 shows the annotated amino acid sequence of SEQ ID NO: 414.
FIG. 181 shows the annotated amino acid sequence of SEQ ID NO: 415.
FIG. 182 shows the annotated amino acid sequence of SEQ ID NO: 416.
FIG. 183 shows the annotated amino acid sequence of SEQ ID NO: 417.
FIG. 184 shows the annotated amino acid sequence of SEQ ID NO: 418.
FIG. 185 shows the annotated amino acid sequence of SEQ ID NO: 419.
FIG. 186 shows the annotated amino acid sequence of SEQ ID NO: 420.
FIG. 187 shows the annotated amino acid sequence of SEQ ID NO: 421.
FIG. 188 shows the annotated amino acid sequence of SEQ ID NO: 422.
FIG. 189 shows the annotated amino acid sequence of SEQ ID NO: 423.
FIG. 190 shows the annotated amino acid sequence of SEQ ID NO: 424.
FIG. 191 shows the annotated amino acid sequence of SEQ ID NO: 425.
FIG. 192 shows the annotated amino acid sequence of SEQ ID NO: 426.
FIG. 193 shows the annotated amino acid sequence of SEQ ID NO: 427.
FIG. 194 shows the annotated amino acid sequence of SEQ ID NO: 428.

FIG. 195 shows the annotated amino acid sequence of SEQ ID NO: 429.
FIG. 196 shows the annotated amino acid sequence of SEQ ID NO: 430.
FIG. 197 shows the annotated amino acid sequence of SEQ ID NO: 431.
FIG. 198 shows the annotated amino acid sequence of SEQ ID NO: 432.
FIG. 199 shows the annotated amino acid sequence of SEQ ID NO: 433.
FIG. 200 shows the annotated amino acid sequence of SEQ ID NO: 434.
FIG. 201 shows the annotated amino acid sequence of SEQ ID NO: 435.
FIG. 202 shows the annotated amino acid sequence of SEQ ID NO: 436.
FIG. 203 shows the annotated amino acid sequence of SEQ ID NO: 437.
FIG. 204 shows the annotated amino acid sequence of SEQ ID NO: 438.
FIG. 205 shows the annotated amino acid sequence of SEQ ID NO: 439.
FIG. 206 shows the annotated amino acid sequence of SEQ ID NO: 440.
FIG. 207 shows the annotated amino acid sequence of SEQ ID NO: 441.
FIG. 208 shows the annotated amino acid sequence of SEQ ID NO: 442.
FIG. 209 shows the annotated amino acid sequence of SEQ ID NO: 443.
FIG. 210 shows the annotated amino acid sequence of SEQ ID NO: 444.
FIG. 211 shows the annotated amino acid sequence of SEQ ID NO: 445.
FIG. 212 shows the annotated amino acid sequence of SEQ ID NO: 446.
FIG. 213 shows the annotated amino acid sequence of SEQ ID NO: 447.
FIG. 214 shows the annotated amino acid sequence of SEQ ID NO: 448.
FIG. 215 shows the annotated amino acid sequence of SEQ ID NO: 449.
FIG. 216 shows the annotated amino acid sequence of SEQ ID NO: 450.
FIG. 217 shows the annotated amino acid sequence of SEQ ID NO: 451.
FIG. 218 shows the annotated amino acid sequence of SEQ ID NO: 452.
FIG. 219 shows the annotated amino acid sequence of SEQ ID NO: 453.
FIG. 220 shows the annotated amino acid sequence of SEQ ID NO: 454.
FIG. 221 shows the annotated amino acid sequence of SEQ ID NO: 455.
FIG. 222 shows the annotated amino acid sequence of SEQ ID NO: 458.
FIG. 223 shows the annotated amino acid sequence of SEQ ID NO: 459.
FIG. 224 shows the annotated amino acid sequence of SEQ ID NO: 460.

DETAILED DESCRIPTION OF THE INVENTION

Figure 225:
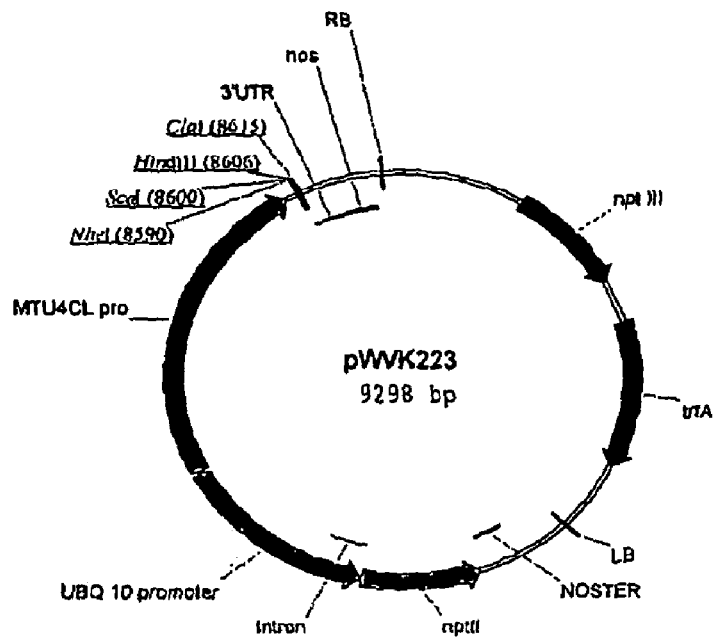
FIG. 225 shows the schematic representation of pWVK223.

The present invention provides isolated polynucleotides that encode wood and cell wall proteins.

Transformation of a plant with a polynucleotide sequence encoding a protein involved in wood and/or cell wall development can be employed to modify properties such as cellulose synthesis, Lignin deposition, aspects of wood development, flower development, root development, branching, seasonal responses such as light and cold controls on meristem identity, and disease resistance. To this end, the present invention provides a polynucleotide sequence encoding a polypeptide sequence having a function in plant cell wall synthesis and/or development. The present invention also provides a DNA construct having a promoter operably linked to a polynucleotide sequence, wherein said polynucleotide sequence encodes a protein involved in the development of the plant cell wall. Additionally, the invention provides methods for assaying the expression of a protein involved in plant cell wall development, methods for using a plant cell wall protein for modifying growth, wood development and/or fiber composition in a plant.

The present invention uses terms and phrases that are well known to those practicing the art. Unless defined otherwise, all technical and scientific terms used herein have the same meaning as commonly understood by one of ordinary skill in the art to which this invention belongs. Generally, the nomenclature used herein and the laboratory procedures in cell culture, molecular genetics, and nucleic acid chemistry and hybridization described herein are those well known and commonly employed in the art. Standard techniques are used for recombinant nucleic acid methods, polynucleotide synthesis, microbial culture, cell culture, tissue culture, transformation, transfection, transduction, analytical chemistry, organic synthetic chemistry, chemical syntheses, chemical analysis, and pharmaceutical formulation and delivery. Generally, enzymatic reactions and purification and/or isolation steps are performed according to the manufacturers' specifications. The techniques and procedures are generally performed according to conventional methodology (Molecular Cloning, A Laboratory Manual, 3rd. edition, edited by Sambrook & Russel Cold Spring Harbor Laboratory Press, Cold Spring Harbor, N.Y., 2001).

A. Plant Wood and Cell Wall Genes and Proteins

Alpha-amylase: Alpha-amylase functions as a major starch hydrolase and hydrolyzes alpha-1,4-glucan bonds. Alpha-amylase transcription occurs in response to a variety of hormonal, metabolic, and environmental signals. Sequence analysis of cloned alpha-amylases reveals that these fall into two major classes and three subfamilies, reviewed by Mitsui and Itoh, *Trends in Plant Science* 2 (7), 255-261 (1997), they are important in the mobilization of endosperm storage compounds during germination to supply the embryo with nutriments.

*Agrobacterium*: as is well known in the field, *Agrobacteria* that are used for transforming plant cells are disarmed and virulent derivatives of, usually, *Agrobacterium tumefaciens* or *Agrobacterium rhizogenes* that contain a vector. The vector typically contains a desired polynucleotide that is located between the borders of a T-DNA.

Angiosperm: vascular plants having seeds enclosed in an ovary. Angiosperms are seed plants that produce flowers that bear fruits. Angiosperms are divided into dicotyledonous and monocotyledonous plants.

Arabinogalactan: Arabinogalactan proteins (AGPs) are a family of cell wall proteins that are glycosylated hydroxyproline-rich glycoproteins and are thought to have important roles in various aspects of plant growth and development. Reviewed by Showalter, A. M. *Cell Mol Life Sci.* 58(10): 1399-417 (2001). Specifically, AGPs are involved during vegetative, reproductive, and cellular growth and development, as well as programmed cell death and cell signaling.

Brassinosteroid-regulated Protein: Brassinosteroids are a class of steroid hormones that regulate plant growth and development. Brassinosteroid-regulated Protein (BRU) is a brassinosteroid-induced protein that functions as a xyloglucan endotransferase (XET). Zurek, D. M., and Clouse, S. D. *Plant Physiol.* 104 (1) 161-170 (1994). Subsequently, similar Brassinolide-induced XETs have been characterized in *Arabidopsis* (Xu et al., *Plant J.* 9, 879-889 (1996)), rice (Uozu et al., *Plant Physiol.* 122, 853-859 (2000)), and tomato (Koka et al., *Plant Physiol.* 122, 85-98 (2000)), demonstrating that the induction of XETs correlates with cell wall loosening during Brassinolide-induced growth β-1,3-endoglucanase: β-1,3-endoglucanase (EC 3.2.1.39) are characterized as pathogenesis-related (PR) proteins because expression in a plant is often induced upon pathogen attack. They have an important role in plant defense, either directly through the degradation of β-1,3/1,6-glucans in the pathogen cell wall, or indirectly by releasing oligosaccharide elicitors that induce additional plant defenses (Kauffmann et al. (1987) *The Embo Journal* 6(11) 3209-3212, Bowles et al. (1990) *Annu. Rev. Biochem.* 59, 873-907, Rose et al. (2002) *The Plant Cell* 14, 1329-1345)). The overexpression of β-1,3-endoglucanases has been shown to be useful for the protection of plants against pathogens, as demonstrated by the transformation of a soybean β-1,3-endoglucanase in tobacco (Borkowska M et al. *Z Naturforsch [C].* (1998) 53(11-12): 1012-10166. Although major interest in β-1,3-endoglucanases stems from their role in plant defense they have also been implicated in a number of physiological and developmental processes in the uninfected plant including cell division, microsporogenesis, pollen germination and tube growth, fertilization, embryogenesis, fruit ripening, seed germination, mobilization of storage reserves in the endosperm of cereal grains, bud dormancy and response to wounding, cold, ozone and UV B (for review see Leubner-Metzer and Meins in *Pathogensis-related proteins in plants*. Datta and Muthukrishnan (eds) CRC Press LLC, Boco Raton, Fla., pp 49-76 (1999)).

β-1,3-glucanase; another name for β-1,3-endoglucanase (EC 3.2.1.39)

β-D-glucan exohydrolase: are widely distributed among yeast and filamentous fungi. Like β-1,3-endoglucanase, exo-1,3-β-glucanases (EC 3.2.1.58) hydrolyze the O-glyco-sidic linkages of 1,3-β-linked glucans. While β-1,3-endoglucanase cleave internal 1,3-β-linkages at random sites along the polysaccharide chain, releasing short oligosaccharides exo-1,3-β-glucanases sequentially release alpha-glucose residues from the non-reducing terminus of 1,3-β-D-glucans. In *Saccharomyces cerevisiae* there is evidence to suggest that they participate in cell wall modifications or in sporulation (Muthukumar et al. (1993) *Journal of Bacteriology* 175(2) 386-396).

β-glucosidase: (EC 3.2.1.21) is responsible for the hydrolysis of terminal, non-reducing β-D-glucose residues with the release of β-D-glucose. The enzyme has been found in plants, animals, bacteria and fungi. In plants, β-glucosidases are reported to function in phytohormone metabolism (Smith and van Staden (1978) *J. Exp. Bot.* 29: 1067-1073), defense against pathogens and herbivours (Poulton (1990) *Plant Physiol.* 94: 401-405 (1990), Li et al. (2005) *Acta Biochim Biophys Sin* (Shanghai). June; 37(6):363-70), and lignification (Hahlbrock and Grsebach (1979) *Ann. Rev. Plant Phyiol.* 30: 105-130).

β-xylosidase: (EC 3.2.1.37) also known as xylan 1,4-β-xylosidase catalyses the hydrolysis of 1,4-β-D-xylans, to remove successive D-xylose residues from the non-reducing termini. They have been reported to occur widely in microorganisms, fungi, animals and recently in plants. In *Arabidopsis* it has been proposed that β-xylosidase has a role in secondary cell wall metabolism and plant development (Goujon et al. (2003) *Plant J* 33:677-690, Minic et al. (2005) *Plant Physiology* 135: 867-878).

Calnexin: Calnexin is an endoplasmic reticulum membrane-bound molecule. Calnexin specifically binds to monoglucosylated N-linked glycans and is thought to play a role in cell wall biosynthesis. It has been demonstrated in yeast that calnexin is required for cell wall biosynthesis and development. For example, a *S. cerevisiae* calnexin strain (designated CNE1⁻) displayed abnormal cell wall development. Thus, it has been suggested that calnexin plays a role in both protein secretion and cell wall synthesis.

Calreticulin: Calreticulin is a multifunctional calcium-binding protein found in the endoplasmic reticulum of most eukaryotic cells. In mammalian cells, the trimming of glucoses is connected to a molecular chaperone cycle involving two lectin-like chaperones, calnexin and calreticulin. Similar to calnexin, calreticulin is believed to play a role in cell wall biosynthesis.

Cellulase: Cellulase refers to any and all enzymes which catalyze the cleavage of cellulosic or lignocellulosic materials. Various genes encoding cellulases have also been isolated and characterized. For instance, genes encoding endoglucanases from the fungus *Trichoderma reesei* are known and have been successfully incorporated and expressed in yeast. Pentilla et al. *Yeast* 3:175-185 (1987). Cellulases are categorized into two large sub-groups based upon whether they catalyze cleavage from the cellulose chain ends (exocellulases) or if they catalyze cleavage in the middle of the cellulose chain (endocellulases).

Cellulose synthase: Cellulose synthase is thought to reside in the plasma membrane as a multisubunit complex, called a rosette, and extrudes β-1,4-glucan into the extracellular matrix. Close proximity of subunits in the rosette complex presumably facilitates the hydrogen bonding of individual glucan chains into tight bundles of characteristic diameter of cellulose microfibrils.

Higher plants contain a large number of closely related genes, the CesA family, that encode a catalytic component of cellulose synthase. It is unknown whether other polypeptides are required to form an active cellulose synthase, and little is known about the regulation of its activity. However, because the deposition of cellulose microfibrils is typically oriented relative to the axis of cellular expansion, an interaction between cellulose synthase and the cortical cytoskeleton has been proposed. A temperature-sensitive mutation in one of the CesA genes, rsw1, leads to a mutant phenotype characterized by swollen cells that are thought to reflect the inability of the cells to resist or direct turgor-mediated expansion. Sugimoto K, Williamson R E, Wasteneys G O. *Protoplasma.* 215(1-4):172-83 (2001). Similar phenotypes have been generated with chemical inhibitors of cellulose biosynthesis, indicating that cellulose in the primary cell wall is required for normal growth. (Delmer, D. P., and Amor, Y. (1995). *Plant Cell* 7, 987-1000; Scheible, W. R., Eshed, R., Richmond, T., Delmer, D., and Somerville, C. R. (2001). *Proc. Natl. Acad. Sci. USA* 98, 10079-10084).

Chitinase: Chitinases catalyze the hydrolysis of N-acetyl-β-D-glucsaminide 1,4-β-linkages in chitin. Although chitin is not a constituent of plants, many plants do synthesize chitinases. These chitinases play a role in plant resistance against pathogens by hydrolyzing chitin which is a common component of fungal cell walls. This is also supported by research that shows that the expression of chitinase in plants led to a reduction in damage caused by pathogens (Broglie et al. (1991) Science 254:1194-1197). It has also been suggested that chitinases have a role in plant development and growth, for a review see Kasprzewska, A (2003) (*Cellular & Molecular Biology Letters* 8: 809-824).

Desired Polynucleotide: a desired polynucleotide of the present invention is a genetic element, such as a promoter, enhancer, or terminator, or gene or polynucleotide that is to be transcribed and/or translated in a transformed cell that comprises the desired polynucleotide in its genome. If the desired polynucleotide comprises a sequence encoding a protein product, the coding region may be operably linked to regulatory elements, such as to a promoter and a terminator, that bring about expression of an associated messenger RNA transcript and/or a protein product encoded by the desired polynucleotide. Thus, a "desired polynucleotide" may comprise a gene that is operably linked in the 5'- to 3'-orientation, a promoter, a gene that encodes a protein, and a terminator. Alternatively, the desired polynucleotide may comprise a gene or fragment thereof, in a "sense" or "antisense" orientation, the transcription of which produces nucleic acids that may affect expression of an endogenous gene in the plant cell. A desired polynucleotide may also yield upon transcription a double-stranded RNA product upon that initiates RNA interference of a gene to which the desired polynucleotide is associated. A desired polynucleotide of the present invention may be positioned within a T-DNA, such that the left and right T-DNA border sequences flank or are on either side of the desired polynucleotide. The present invention envisions the stable integration of one or more desired polynucleotides into the genome of at least one plant cell. A desired polynucleotide may be mutated or a variant of its wild-type sequence. It is understood that all or part of the desired polynucleotide can be integrated into the genome of a plant. It also is understood that the term "desired polynucleotide" encompasses one or more of such polynucleotides. Thus, a T-DNA of the present invention may comprise one, two, three, four, five, six, seven, eight, nine, ten, or more desired polynucleotides.

Dicotyledonous plant (dicot): a flowering plant whose embryos have two seed halves or cotyledons, branching leaf veins, and flower parts in multiples of four or five. Examples of dicots include but are not limited to, *Eucalyptus, Populus, Liquidamber, Acacia*, teak, mahogany, cotton, tobacco, *Arabidopsis*, tomato, potato sugar beet, broccoli, cassava, sweet potato, pepper, poinsettia, bean, alfalfa, soybean, carrot, strawberry, lettuce, oak, maple, walnut, rose, mint, squash, daisy, geranium, avocado, and cactus.

Dirigent: Dirigent proteins are a unique class of plant proteins that control free-radical coupling during lignin formation and lignification. Gang, D. R. et al. *Chem Biol.* 6(3):143-51 (1999). Lignification is a very precise process and moves from the outer wall of the cell inward towards the plasma membrane, and it has been shown that lignification sites in the outer wall house dirigent proteins. Davin, N. B. and N. G. Lewis. *Plant Physiol.* 123(2):453-62 (2000). Dirigent immunolocalization studies reveal cross-reactivity with particular regions of the lignified cell walls, these being coincident with the known sites of initiation of lignin deposition. Burlat, V. et al. *Phytochemistry* 57(6):883-97 (2001).

Endogenous refers to a gene that is native to a plant genome.

Expansin: Expansins are a class of proteins that regulate cell wall extension during growth. McQueen-Mason et al. *Plant Cell* 4: 1425-1433 (1992). In addition to their role during wall loosening, expansins are thought to play roles in cell wall extension, pollination, and fruit ripening. Cosgrove, D. J. *Proc Natl Acad Sci USA.* 27; 94(11):5504-5 (1997). Expansins are commonly encoded by several gene families and have classically been divided into two subfamilies, alpha- and beta-expansins. Alpha-expansins are a highly conserved group of proteins hypothesized to control cell wall enlargement and other developmental processes including cell wall disassembly and cell separation. Beta-expansins, previously known as group-1 grass pollen allergens, are secreted by grass pollen and impart wall loosening effects on grass cell walls. Beta-expansins are found in non-pollen tissues and may play a developmental role in wall-loosening.

Extensin: Extensins refer to a class of hydroxyproline-rich glycoproteins found in the cell walls of higher plants. Extensins are thought to reinforce the cell wall by inter- and intramolecule interactions. Merkouropoulos, G. et al. *Planta* 208(2):212-9 (1999). Extensins are normally expressed in the root and silent in the leaf; however, wounding reverses this pattern, turning on the gene in the leaf and repressing it in the root. Id. Because extensins are activated by several stress-inducing signals, including wounding, methyl jasmonate, salicylic acid, and abscisic acid, extensins are thought to play a defense role by reinforcing and strengthening the cell wall.

Fiber composition: as used herein, fiber composition refers to trait that can be modified to change the structure, appearance, or use of fiber. While not limiting, traits that determine fiber composition include fiber length, coarseness, strength, color, cross-sectional, and fiber density. For example, it is known that fiber length imparts strength, whereas fiber coarseness determines texture and flexibility.

Foreign: "foreign," with respect to a nucleic acid, means that that nucleic acid is derived from non-plant organisms, or derived from a plant that is not the same species as the plant to be transformed or is not derived from a plant that is not interfertile with the plant to be transformed, does not belong to the species of the target plant. According to the present invention, foreign DNA or RNA represents nucleic acids that are naturally occurring in the genetic makeup of fungi, bacteria, viruses, mammals, fish or birds, but are not naturally occurring in the plant that is to be transformed. Thus, a foreign nucleic acid is one that encodes, for instance, a polypeptide that is not naturally produced by the transformed plant. A foreign nucleic acid does not have to encode a protein product.

Galacturan 1,4-alpha-galacturonidase: Galacturan 1,4-alpha-galacturonidase (also called exopolygalacturonase or ExoPG) is a pectin degrading enzyme. ExoPG degrades pectin by removing galacturonate monomers from the polygalacturonate chain component of pectin. Using immunochemistry and in situ hybridization, it has been shown that in addition to its presence in pollen, ExoPG is also present in sporophytic tissues, such as the tapetum and mesophyll cells. Dubald, M. et al. *Plant J.* 4(5):781-91 (1993). ExoPG is also though to play a role during fungal pathogenesis; for example, a novel ExoPG was identified as the causative agent responsible for foot crown and root rot disease in tomato plants. De las Heras, A. *J Appl Microbiol.* 94(5):856-64 (2003). These results suggest a general function for ExoPG in cell wall degradation.

Gene: A gene is a segment of a DNA molecule that contains all the information required for synthesis of a product, polypeptide chain or RNA molecule that includes both coding and non-coding sequences.

Genetic element: a "genetic element" is any discreet nucleotide sequence such as, but not limited to, a promoter, gene, terminator, intron, enhancer, spacer, 5'-untranslated region, 3'-untranslated region, or recombinase recognition site.

Genetic modification: stable introduction of DNA into the genome of certain organisms by applying methods in molecular and cell biology.

Glucose-1-phosphate adenyltransferase: Glucose-1-phosphate adenyltransferase (AGP) catalyzes one of the first committed steps in the starch biosynthesis pathway, the production of ADP-Glucose from Glucose-1-phosphate and ATP. AGP regulates starch accumulation, as AGP mutants have decreased starch accumulation. Wang S-M, Chu B. Lue W-L, Yu T-S, Eimert K, Chen J (1997). Plant J 11: 1121-1126.

Glycoside hydrolase: Glycoside hydrolases are one of two major classes of carbohydrate-active enzymes, glycoside hydrolases and glycosyltransferases. They frequently display a modular structure: a catalytic domain, responsible for a hydrolysis reaction breaking down a glycoside, and a cellulose-binding module, devoid of catalytic activity but promoting adsorption of the enzyme onto insoluble crystalline cellulose. They are related in structure to chitinases and concanavalin A. Bernard Henrissat and Gideon J. Davies. Glycoside Hydrolases and Glycosyltransferases. Families, Modules, and Implications for Genomics. Plant Physiol, December 2000, Vol. 124, pp. 1515-1519.

Glycosyl hydrolase: Glycosyl hydrolases are a general class of enzymes that break bonds between sugar moieties. This class includes alpha-amylase, alpha-galactosidase, endo and exo-beta-glucanases, etc.

Glycosyl transferase: Glycosyltransferases are one of two major classes of carbohydrate-active enzymes, glycoside hydrolases and glycosyltransferases. They frequently display a modular structure: a catalytic domain, responsible for a reaction adding a glycoside moiety, and a cellulose-binding module, devoid of catalytic activity but promoting adsorption of the enzyme onto insoluble crystalline cellulose. They are related in structure to chitin synthases. Bernard Henrissat and Gideon J. Davies. Glycoside Hydrolases and Glycosyltransferases. Families, Modules, and Implications for Genomics. Plant Physiol, December 2000, Vol. 124, pp. 1515-1519.

Gymnosperm: as used herein, refers to a seed plant that bears seed without ovaries. Examples of gymnosperms include conifers, cycads, ginkgos, and ephedras.

Hexose Pyrophosphorylase: Hexose Pyrophosphorylases (EC 2.7.7.28) are a class of enzymes that have tranferase activity transferring phosphorous containing groups. They catalyze the reaction: hexose 1-phosphate+nucleoside triphosphate=NDP-hexose+diphosphate (Verachtert et al. (1966) Journal Biol. Chem. 241(9) 2007-2013).

Hydroxyproline-rich proteins: Hydroxyproline-rich proteins (HRGPs) are a large class of plant cell wall proteins and are the best studied cell wall proteins. While the precise function of HRGPs remains unknown, HRGPs are induced by wounding and pathogen infection, suggesting a role in reinforcing and strengthening the cell wall. Additionally, HRGPs may also provide nucleating sites for lignification during secondary wall formation. Vignols, F. Plant Mol. Biol. 39(5): 945-52 (1999).

Introduction: as used herein, refers to the insertion of a nucleic acid sequence into a cell, by methods including infection, transfection, transformation or transduction.

Juvenility: describes a physiological difference between a young tree and a mature tree. In the present invention, juvenility refers to differences in microfibril angle, wood density, cellulose yield, regenerability, and reproductive ability between a young tree and a mature tree. For example, it has been shown that as a plant tissue matures, the tissue loses its ability to regenerate.

Lignin: as used herein, refers to a polymeric composition composed of phenylpropanoid units, including polymerized derivatives of monolignols coniferyl, coumaryl, and sinapyl alcohol. Lignin quality refers to the ability of a lignin composition to impart strength to cell wall matrices, assist in the transport of water, and/or impede degradation of cell wall polysaccharides. Lignin composition or lignin structure may be changed by altering the relative amounts of each of monolignols or by altering the type of lignin. For example, guaiacyl lignins (derived primarily from ferulic acid) are prominent in softwood species, whereas guaiacyl-syringyl lignins (derived from both ferulic acid and sinapic acid) are characteristic of hardwood species. The degradation of lignin from softwoods, such as pine, requires substantially more alkali and longer incubations, compared with the removal of lignin from hardwoods. Additionally, lignin composition may be regulated by either up-regulation or down-regulation of enzymes involved lignin biosynthesis. For example, key lignin biosynthesis enzymes include 4-coumaric acid: coenzyme A ligase (4CL), Cinnamyl Alcohol dehydrogenase (CAD), and Sinapyl Alcohol Dehydrogenase (SAD).

Mannose-6-phosphate isomerase: Mannose-6-phosphate isomerase catalyzes the interconversion of mannose-6-phosphate to fructose-6-phosphate. There is a distinct lack of literature regarding plant mannose-6-phosphate isomerases, as it has not been identified in many plants.

Mannose-1-phosphate guanylytransferase: Mannose-1-phosphate guanylytransferase catalyzes the biosynthesis of GDP-mamose from mannose-6-phosphate and plays a role in cell wall biosynthesis. Specifically, mannose-1-phosphate guanylytransferase is thought to represent the first committed step in the formation of all plant guanosin-containing sugar nucleotides, which are precursors for cell wall biosynthesis. For example, Arabidopsis cyt1 mutants are deficient in mannose-1-phosphate guanylytransferase and display a severe defect in cell wall biogenesis. Lukowitz, N. et al. Proc Natl Acad Sci USA.; 98(5):2262-7 (2001). Notably, cyt1 mutants display ectopic callose accumulation, incomplete cell walls, and a 5-fold decrease in cellulose content. Id.

Monocotyledonous plant (monocot): a flowering plant having embryos with one cotyledon or seed leaf, parallel leaf veins, and flower parts in multiples of three. Examples of monocots include, but are not limited to turfgrass, maize, rice, oat, wheat, barley, sorghum, orchid, iris, lily, onion, and palm. Examples of turfgrass include, but are not limited to Agrostis spp. (bentgrass species including colonial bentgrass and creeping bentgrasses), Poa pratensis (kentucky bluegrass), Lolium spp. (ryegrass species including annual ryegrass and perennial ryegrass), Festuca arundinacea (tall fescue) Festuca rubra commutata (fine fescue), Cynodon dactylon (common bermudagrass varieties including Tifgreen, Tifway II, and Santa Ana, as well as hybrids thereof); Pennisetum clandestinum (kikuyugrass), Stenotaphrum secundatum (st. augustinegrass), Zoysia japonica (zoysiagrass), and Dichondra micrantha.

Nucleotidyl transferase: [EC 2.7.7] any member of a sub-subclass of enzymes of the transferase class that catalyze the transfer of a nucleotidyl group from a nucleoside di- or triphosphate donor group to an acceptor group. Nucleotidyl transferases are involved in a variety of biological processes including replication and repair, transcription, RNA processing and viral replication (Aravind and Koonin (1999) *Nucleic Acid Research* 27(7) 1609-1618).

Operably linked: combining two or more molecules in such a fashion that in combination they function properly in a plant cell. For instance, a promoter is operably linked to a structural gene when the promoter controls transcription of the structural gene.

Pectins: Pectins are complex polymers and they are thought to perform many functions, such as determining cell wall porosity and providing charged surfaces for modulating cell wall pH and ion balance. Additionally, pectins may play a role in cell signaling by recognizing compounds and then relaying a response in a developmental cascade.

Pectin methylesterase: Pectin methylesterase catalyzes the hydrolysis of pectin into pectate and methanol, and plays an important role during fruit ripening. Specifically, pectin methylesterase is thought to play a role in cell wall metabolism. Additionally, several plant pathogens use pectinesterases to macerate and soft-rot plant tissues. The *Arabidopsis* genome contains at least 12 pectin methylesterase related genes. Micheli et al. *Gene* 5; 220(1-2):13-20 (1998).

Phenotype: phenotype is a distinguishing feature or characteristic of a plant, which may be altered according to the present invention by integrating one or more "desired polynucleotides" and/or screenable/selectable markers into the genome of at least one plant cell of a transformed plant. The "desired polynucleotide(s)" and/or markers may confer a change in the phenotype of a transformed plant, by modifying any one of a number of genetic, molecular, biochemical, physiological, morphological, or agronomic characteristics or properties of the transformed plant cell or plant as a whole. Thus, expression of one or more, stably integrated desired polynucleotide(s) in a plant genome, may yield a phenotype selected from the group consisting of, but not limited to, increased drought tolerance, enhanced cold and frost tolerance, improved vigor, enhanced color, enhanced health and nutritional characteristics, improved storage, enhanced yield, enhanced salt tolerance, enhanced heavy metal tolerance, increased disease tolerance, increased insect tolerance, increased water-stress tolerance, enhanced sweetness, improved vigor, improved taste, improved texture, decreased phosphate content, increased germination, increased micronutrient uptake, improved starch composition, and improved flower longevity.

Phosphomannomutase: Phosphomannomutase 2 catalyzes the isomerization of mannose 6-phosphate to mannose 1-phosphate. Popova TN, Matasova LV, Lapot'ko AA. Purification, separation and characterization of phosphoglucomutase and phosphomannomutase from maize leaves. Biochem Mol Biol Int. 1998 October; 46(3):461-70.

Plant disease resistance response protein: Plant disease resistance genes have been exhaustively investigated in terms of their structural organization, sequence evolution and genome distribution. This has been well reviewed in Lehmann P *J Appl Genet.*; 43(4):403-14 (2002). Most plant disease resistance (R) proteins contain a series of leucine-rich repeats (LRRs), a nucleotide-binding site (NBS), and a putative amino-terminal signaling domain. They are termed NBS-LRR proteins. The LRRs of a wide variety of proteins from many organisms serve as protein interaction platforms, and as regulatory modules of protein activation. Genetically, the LRRs of plant R proteins are determinants of response specificity, and their action can lead to plant cell death in the form of the familiar hypersensitive response (HR). The partners or R proteins remain unclear but current knowledge is reviewed in Belkhadir Y, et al, *Curr Opin Plant Biol.* 7(4):391-9 (2004).

Plant tissue: a "plant" is any of various photosynthetic, eukaryotic, multicellular organisms of the kingdom Plantae characteristically producing embryos, containing chloroplasts, and having cellulose cell walls. A part of a plant, i.e., a "plant tissue" may be treated according to the methods of the present invention to produce a transgenic plant. Many suitable plant tissues can be transformed according to the present invention and include, but are not limited to, somatic embryos, pollen, leaves, stems, calli, stolons, microtubers, and shoots. Thus, the present invention envisions the transformation of angiosperm and gymnosperm plants such as turfgrass, wheat, maize, rice, barley, oat, sugar beet, potato, tomato, tobacco, alfalfa, lettuce, carrot, strawberry, cassava, sweet potato, geranium, soybean, oak, pine, fir, acacia, eucalyptus, walnut, and palm. According to the present invention "plant tissue" also encompasses plant cells. Plant cells include suspension cultures, callus, embryos, meristematic regions, callus tissue, leaves, roots, shoots, gametophytes, sporophytes, pollen, seeds and microspores. Plant tissues may be at various stages of maturity and may be grown in liquid or solid culture, or in soil or suitable media in pots, greenhouses or fields. A plant tissue also refers to any clone of such a plant, seed, progeny, propagule whether generated sexually or asexually, and descendents of any of these, such as cuttings or seed. Of particular interest are conifers such as pine, fir and spruce, monocots such as Kentucky bluegrass, creeping bentgrass, maize, and wheat, and dicots such as cotton, tomato, lettuce, *Arabidopsis*, tobacco, and geranium.

Plant transformation and cell culture: broadly refers to the process by which plant cells are genetically modified and transferred to an appropriate plant culture medium for maintenance, further growth, and/or further development. Such methods are well known to the skilled artisan.

Polygalacturonase: Polygalacturonase (Pectin depolymerase, pectinase, PG) degrades the plant cell wall by depolymerizing pectin. Polygalacturonase depolymerizes pectin during a variety of developmental processes, including pollination and fruit ripening. Additionally, many plant pathogens secrete polygalacturonase during host infection, thereby degrading the host cell wall.

Progeny: a "progeny" of the present invention, such as the progeny of a transgenic plant, is one that is born of, begotten by, or derived from a plant or the transgenic plant. Thus, a "progeny" plant, i.e., an "F1" generation plant is an offspring or a descendant of the transgenic plant produced by the inventive methods. A progeny of a transgenic plant may contain in at least one, some, or all of its cell genomes, the desired polynucleotide that was integrated into a cell of the parent transgenic plant by the methods described herein. Thus, the desired polynucleotide is "transmitted" or "inherited" by the progeny plant. The desired polynucleotide that is so inherited in the progeny plant may reside within a T-DNA construct, which also is inherited by the progeny plant from its parent. The term "progeny" as used herein, also may be considered to be the offspring or descendants of a group of plants.

Promoter: promoter is intended to mean a nucleic acid, preferably DNA that binds RNA polymerase and/or other transcription regulatory elements. As with any promoter, the promoters of the current invention will facilitate or control the transcription of DNA or RNA to generate an mRNA molecule from a nucleic acid molecule that is operably linked to the promoter. As stated earlier, the RNA generated may code for a protein or polypeptide or may code for an RNA interfering, or antisense molecule.

A plant promoter is a promoter capable of initiating transcription in plant cells whether or not its origin is a plant cell. Exemplary plant promoters include, but are not limited to, those that are obtained from plants, plant viruses, and bacteria such as *Agrobacterium* or *Rhizobium* which comprise genes expressed in plant cells. Examples of promoters under developmental control include promoters that preferentially initiate transcription in certain tissues, such as xylem, leaves, roots, or seeds. Such promoters are referred to as tissue-preferred promoters. Promoters which initiate transcription only in certain tissues are referred to as tissue-specific promoters. A cell type-specific promoter primarily drives expression in certain cell types in one or more organs, for example, vascular cells in roots or leaves. An inducible or repressible promoter is a promoter which is under environmental control. Examples of environmental conditions that may effect transcription by inducible promoters include anaerobic conditions or the presence of light. Tissue specific, tissue preferred, cell type specific, and inducible promoters constitute the class of non-constitutive promoters. A constitutive promoter is a promoter which is active under most environmental conditions, and in most plant parts.

Pollen allergen/expansin: Group I allergens are the major allergens of grass pollen and they have been shown to be structurally related to expansin (Cosgrove D J et al, *Proc Natl Acad Sci USA*. 1997 Jun. 10; 94(12):6559-64). Expansins are now generally accepted to be key regulators of wall extension during growth. Their exact mode of function is unclear, but in plants, expansins probably increase solubilisation of wall polymers during wall breakdown. There is evidence that expansins enhance growth by mediating cell wall loosening (Choi D, Lee Y, Cho H T, Kende H *Plant Cell.* 2003 June; 15(6):1386-98), have a role in plant morphogenesis (Pien S, Wyrzykowska J, McQueen-Mason S, Smart C, Fleming A. *Proc Natl Acad Sci USA.* 2001 Sep. 25; 98(20):11812-7) and are important in cell wall breakdown or softening in processes such as fruit ripening, pollination, germination and abscission (Li Y, Jones L, McQueen-Mason S, *Curr Opin Plant Biol.* 2003 December; 6(6):603-10).

Polynucleotide is a nucleotide sequence, comprising a gene coding sequence or a fragment thereof, (comprising at least 15 consecutive nucleotides; preferably at least 30 consecutive nucleotides, and more preferably at least 50 consecutive nucleotides), a promoter, an intron, an enhancer region, a polyadenylation site, a translation initiation site, 5' or 3' untranslated regions, a reporter gene, a selectable marker or the like. The polynucleotide may comprise single stranded or double stranded DNA or RNA. The polynucleotide may comprise modified bases or a modified backbone. The polynucleotide may be genomic, an RNA transcript (such as an mRNA) or a processed nucleotide sequence (such as a cDNA). The polynucleotide may comprise a sequence in either sense or antisense orientations.

An isolated polynucleotide is a polynucleotide sequence that is not in its native state, e.g., the polynucleotide is comprised of a nucleotide sequence not found in nature or the polynucleotide is separated from nucleotide sequences with which it typically is in proximity or is next to nucleotide sequences with which it typically is not in proximity.

Regenerability: as used herein, refers to the ability of a plant to redifferentiate from a de-differentiated tissue.

Seed: a "seed" may be regarded as a ripened plant ovule containing an embryo, and a propagative part of a plant, as a tuber or spore. Seed may be incubated prior to *Agrobacterium*-mediated transformation, in the dark, for instance, to facilitate germination. Seed also may be sterilized prior to incubation, such as by brief treatment with bleach. The resultant seedling can then be exposed to a desired strain of *Agrobacterium*.

Selectable/screenable marker: a gene that, if expressed in plants or plant tissues, makes it possible to distinguish them from other plants or plant tissues that do not express that gene. Screening procedures may require assays for expression of proteins encoded by the screenable marker gene. Examples of such markers include the beta glucuronidase (GUS) gene and the luciferase (LUX) gene. Examples of selectable markers include the neomycin phosphotransferase (NPTII) gene encoding kanamycin and geneticin resistance, the hygromycin phosphotransferase (HPT or APHIV) gene encoding resistance to hygromycin, acetolactate synthase (als) genes encoding resistance to sulfonylurea-type herbicides, genes (BAR and/or PAT) coding for resistance to herbicides which act to inhibit the action of glutamine synthase such as phosphinothricin (Liberty or Basta), or other similar genes known in the art.

Sequence identity: as used herein, "sequence identity" or "identity" in the context of two nucleic acid or polypeptide sequences includes reference to the residues in the two sequences which are the same when aligned for maximum correspondence over a specified region. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are said to have "sequence similarity" or "similarity." Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Meyers and Miller, *Computer Applic. Biol. Sci.,* 4: 11-17 (1988) e.g., as implemented in the program PC/GENE (Intelligenetics, Mountain View, Calif., USA).

As used herein, percentage of sequence identity means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

"Sequence identity" has an art-recognized meaning and can be calculated using published techniques. See COMPUTATIONAL MOLECULAR BIOLOGY, Lesk, ed. (Oxford University Press, 1988), BIOCOMPUTING: INFORMATICS AND GENOME PROJECTS, Smith, ed. (Academic Press, 1993), COMPUTER ANALYSIS OF SEQUENCE DATA, PART I, Griffin & Griffin, eds., (Humana Press, 1994), SEQUENCE ANALYSIS IN MOLECULAR BIOLOGY, Von Heinje ed., Academic Press (1987), SEQUENCE ANALYSIS PRIMER, Gribskov & Devereux, eds. (Macmillan Stockton Press, 1991), and Carillo & Lipton, *SIAM J. Applied Math.* 48:1073 (1988). Methods commonly employed to determine identity or similarity between two sequences include but are not limited to those disclosed in GUIDE TO HUGE COMPUTERS, Bishop, ed., (Academic Press, 1994) and Carillo & Lipton, supra. Methods to determine identity and similarity are codified in computer programs. Preferred computer program methods to determine identity and similarity between two sequences include but are not limited to the GCG program package (Devereux et al., *Nucleic Acids Research* 12: 387 (1984)), BLASTP, BLASTN, FASTA (Atschul et al., *J. Mol. Biol.* 215: 403 (1990)), and FASTDB (Brutlag et al., *Comp. App. Biosci.* 6: 237 (1990)).

Starch: Starch is an insoluble stable carbohydrate reserve present in almost all plants. Starch is synthesized from triose phosphate generated from the Calvin cycle and starch synthesis occurs in the chloroplast. Starch polymers are composed of two different types of glucan polymers, amylase and amylopectin.

Starch Branching Enzyme: Starch Branching Enzyme (SBE) is one of the key enzymes involved in starch synthesis. SBE introduces alpha-1,6 glucan branches and is thought to influence amylopectin structure. All higher plants have two classes of SBE, referred to as BEI and BEII in maize, rice, wheat, and barley; and as B-type and A-type in pea, kidney bean, and potato. Biochemical analyses with maize revealed that BEI preferentially branches amylose-type fewer branched polyglucans, whereas BEII has a higher capacity for branching amylopectin-type highly branched alpha-glucans. Guan, H. P and Preiss, *J. Plant Physiol* 102: 1269-1273 (1993). These data strongly suggest that BEI and BEII play distinct roles in amylopectin synthesis. Nakamura, Y. *Plant Cell Physiol* 43: 718-725 (2002).

Starch Synthase: Starch synthase is thought to elongate both amylase and amylopectin polymers by adding an ADP-glucose molecule to the nascent polymer. Starch synthase occurs in 2 different forms: soluble starch synthase and granule-bound starch synthase. Starch synthase proteins share a common KXGG motif, which is thought to provide an ADP-glucose binding site. Knight, M. E. et al. *Plant J* 14(5):613-22 (1998).

Sucrose synthase: Sucrose synthase plays an important role partitioning sucrose between cell wall biosynthesis and glycolysis. Several reports demonstrate that sucrose synthase acts as a metabolic channel for transferring glucose, derived from sucrose, to a growing cellulose chain. For example, in the roots of wheat (*Triticum aestivum* L. cv. Alcedoroot), elevated sugar content is used for synthesizing cellulose for secondary wall thickening. Albrecht, G. and Mustoph, A. *Planta* 217(2):252-60 (2003). Additionally, suppression of sucrose synthase gene (Sus) in the ovule epidermis of cotton led to a fiberless phenotype. Ruan et al. *Plant Cell* 15(4):952-64 (2003). The level of Sus suppression correlated strongly with the degree of inhibition of fiber initiation and elongation. Ruan et al. *Plant Cell* 15(4):952-64 (2003). Furthermore, it has been shown that antisense repression of sucrose synthase in carrot (*Daucus carota* L.) affects growth rather than sucrose partitioning. Tang G Q and Sturm A. *Plant Mol Biol.* 41(4):465-79 (1999).

Sucrose-phosphate synthase (SPS) catalyzes a reversible reaction in the pathway of sucrose synthesis, the formation of sucrose-6-phosphate from fructose-6-phosphate (Fru6P) and UDPGlucose (UDPGlc), and is the major limiting enzyme for sucrose synthesis. Additionally, sucrose-phosphate synthase plays a role during cell growth. For example, a gene underlying a quantitative trait locus (QTL) controlling plant height in rice (*Oryza sativa* L.) suggests that a putative sucrose phosphate synthase gene controls plant height by enabling higher amounts of sucrose to be translocated in leaves. Ishimaru et al. *Planta* 218(3):388-95 (2004). Transgenic rice plants with a maize SPS gene that had about 3 times the SPS activity of control plants and were significantly taller than control plants. Id.

Several studies have demonstrated that SPS regulates photosynthetic partitioning in the plant. For example, tomato plants expressing a maize SPS showed 2-3-fold increases in SPS activity, increased partitioning of photoassimilate to sucrose, and up to 58% higher maximal rates of photosynthesis. Lunn, J. E. et al. *J Exp Bot.* 54(381):223-37 (2003). Increased SPS expression correlated with altered shoot:root dry weight ratio, favoring the shoot. Galtier, N. *Plant Physiol.* 101(2):535-543 (1993). Accordingly, regulating SPS expression may allow for increased photosynthetic rates during unfavorable conditions. Id.

Syringolide-induced Protein: Syringolide is produced by the bacterial plant pathogen *Pseudomonas syringae* and is believed to enter the plant through passive diffusion (Ji et al. (1998) *Proc. Natl. Acad. Sci. USA* 95: 3306-3311). In soybean leaf tissue, it induces Rpg4-specific hypersensitive cell death but very little is know about signaling in the syringolide/soybean system.

Transcription factor: Transcription factor refers to a polypeptide sequence that regulates the expression of a gene or genes by either directly binding to one or more nucleotide sequences associated with a gene coding sequence or indirectly affecting the activity of another polypeptide(s) that binds directly to one or more nucleotide sequences associated with a gene coding sequence. A transcription factor may activate (up-regulate) or repress (down-regulate) expression of a gene or genes. A transcription factor may contain a DNA binding domain, an activation domain, or a domain for protein-protein interactions. In the present invention, a transcription factor is capable of at least one of (1) binding to a nucleic acid sequence or (2) regulating expression of a gene in a plant. Additionally, the inventive polynucleotide sequences and the corresponding polypeptide sequences function as transcription factors in any plant species, including angiosperms and gymnosperms.

Transcription and translation terminators: The expression DNA constructs of the present invention typically have a transcriptional termination region at the opposite end from the transcription initiation regulatory region. The transcriptional termination region may be selected, for stability of the mRNA to enhance expression and/or for the addition of polyadenylation tails added to the gene transcription product. Translation of a nascent polypeptide undergoes termination when any of the three chain-termination codons enters the A site on the ribosome. Translation termination codons are UAA, UAG, and UGA.

Transfer DNA (T-DNA): an *Agrobacterium* T-DNA is a genetic element that is well-known as an element capable of integrating a nucleotide sequence contained within its borders into another genome. In this respect, a T-DNA is flanked, typically, by two "border" sequences. A desired polynucleotide of the present invention and a selectable marker may be positioned between the left border-like sequence and the right border-like sequence of a T-DNA. The desired polynucleotide and selectable marker contained within the T-DNA may be operably linked to a variety of different, plant-specific (i.e., native), or foreign nucleic acids, like promoter and terminator regulatory elements that facilitate its expression, i.e., transcription and/or translation of the DNA sequence encoded by the desired polynucleotide or selectable marker.

Transformation of plant cells: A process by which a nucleic acid is stably inserted into the genome of a plant cell. Transformation may occur under natural or artificial conditions using various methods well known in the art. Transformation may rely on any known method for the insertion of nucleic acid sequences into a prokaryotic or eukaryotic host cell, including *Agrobacterium*-mediated transformation protocols, viral infection, whiskers, electroporation, microinjection, polyethylene glycol-treatment, heat shock, lipofection and particle bombardment.

Transgenic plant: a transgenic plant of the present invention is one that comprises at least one cell genome in which an exogenous nucleic acid has been stably integrated. According to the present invention, a transgenic plant is a plant that comprises only one genetically modified cell and cell genome, or is a plant that comprises some genetically modified cells, or is a plant in which all of the cells are genetically modified. A transgenic plant of the present invention may be one that comprises expression of the desired polynucleotide, i.e., the exogenous nucleic acid, in only certain parts of the plant. Thus, a transgenic plant may contain only genetically modified cells in certain parts of its structure.

UTP-glucose-1-phosphate uridylyltransferase: UTP-glucose-1-phosphate uridylyltransferase (UGP) catalyzes the conversion of alpha-D-glucose-1-phosphate and UTP to diphosphate and UDP-glucose. UDP-glucose is a key component of polysaccharide biosynthesis and can be combined with D-fructose for sucrose synthesis.

Variant: a "variant," as used herein, is understood to mean a nucleotide or amino acid sequence that deviates from the standard, or given, nucleotide or amino acid sequence of a particular gene or protein. The terms, "isoform," "isotype," and "analog" also refer to "variant" forms of a nucleotide or an amino acid sequence. An amino acid sequence that is altered by the addition, removal or substitution of one or more amino acids, or a change in nucleotide sequence, may be considered a "variant" sequence. The variant may have "conservative" changes, wherein a substituted amino acid has similar structural or chemical properties, e.g., replacement of leucine with isoleucine. A variant may have "nonconservative" changes, e.g., replacement of a glycine with a typtophan. Analogous minor variations may also include amino acid deletions or insertions, or both. Guidance in determining which amino acid residues may be substituted, inserted, or deleted may be found using computer programs well known in the art such as Vector NTI Suite (InforMax, MD) software. "Variant" may also refer to a "shuffled gene" such as those described in Maxygen-assigned patents. For instance, a variant of the present invention may include variants of sequences and desired polynucleotides that are modified according to the methods and rationale disclosed in U.S. Pat. No. 6,132,970, which is incorporated herein by reference.

Wood composition, as used herein, refers to trait that can be modified to change the structure, appearance, or use of wood. While not limiting, traits that determine wood composition include cell wall thickness, cell length, cell density, microfibril angle, tensile strength, tear strength, wood color, and length and frequency of cell division.

Wood pulp refers to fiber generated from wood having varying degrees of purification. Wood pulp can be used for producing paper, paper board, and chemical products.

The invention provides methods of obtaining wood, wood pulp, paper, and oil from a plant transformed with a construct of the present invention. Methods for transforming and selecting a transgenic plant are known in the art. For example, pine can be cultured and grown as described in U.S. Patent Application Publication No. 2002/0100083. *Eucalyptus* can be cultured and grown as in, for example, Rydelius, et al., Growing *Eucalyptus* for Pulp and Energy, presented at the Mechanization in Short Rotation, Intensive Culture Forestry Conference, Mobile, Ala., 1994. Wood, wood pulp, paper, and oil can be obtained from the plant by any means known in the art.

As noted above, the wood and wood pulp obtained in accordance with this invention may demonstrate improved characteristics including, but not limited to any one or more of lignin composition, lignin structure, wood composition, cellulose polymerization, fiber dimensions, ratio of fibers to other plant components, plant cell division, plant cell development, number of cells per unit area, cell size, cell shape, cell wall composition, rate of wood formation, aesthetic appearance of wood, formation of stem defects, rate of growth, rate of root formation ratio of root to branch vegetative development, leaf area index, and leaf shape include increased or decreased lignin content, increased accessibility of lignin to chemical treatments, improved reactivity of lignin, increased or decreased cellulose content increased dimensional stability, increased tensile strength, increased shear strength, increased compression strength, increased shock resistance, increased stiffness, increased or decreased hardness, decreased spirality, decreased shrinkage, and differences in weight, density, and specific gravity.

Phenotype can be assessed by any suitable means. The plants can be evaluated based on their general morphology. Transgenic plants can be observed with the naked eye, can be weighed and their height measured. The plant can be examined by isolating individual layers of plant tissue, namely phloem and cambium, which is further sectioned into meristematic cells, early expansion, late expansion, secondary wall formation, and late cell maturation. See, e.g., Hertzberg, supra. The plants also can be assessed using microscopic analysis or chemical analysis.

Microscopic analysis includes examining cell types, stage of development, and stain uptake by tissues and cells. Fiber morphology, such as fiber wall thickness and microfibril angle of wood pulp fibers can be observed using, for example, microscopic transmission ellipsometry. See Ye and Sundström, *Tappi J,* 80:181 (1997). Wood strength, density, and grain slope in wet wood and standing trees can be determined by measuring the visible and near infrared spectral data in conjunction with multivariate analysis. See, U.S. Patent Application Publication Nos. 2002/0107644 and 2002/0113212. Lumen size can be measured using scanning electron microscopy. Lignin structure and chemical properties can be observed using nuclear magnetic resonance spectroscopy as described in Marita et al., *J. Chem. Soc., Perkin Trans. I* 2939 (2001).

The biochemical characteristic of lignin, cellulose, carbohydrates and other plant extracts can be evaluated by any standard analytical method known including spectrophotometry, fluorescence spectroscopy, HPLC, mass spectroscopy, and tissue staining methods.

Xyloglucan Endotransglycosylase: Xyloglucan Endotransglycosylase (XET) can cut and rejoin xyloglucan (XG) chains and thus has been implicated in many aspects of cell wall biosynthesis. It is considered to be a key agent in regulating cell expansion (Darley et al (2001) *Plant Mol. Biol.* 47: 179-195, Wu et al. (2005) *Planta.* 220(4):593-601), has been implicated in wall degradation needed for fruit ripening, lisogenous aerenchyma, abscission and the wall strengthening that takes place during movement of a plant (reviewed by Nishitani (1997) *Int. Rev. Cytol.* 173: 157-206 and Campbell and Braam (1999 *Trends Plant Sci.* 4: 361-366).

Several studies have demonstrated roles for XET during cell wall formation. For example, XET activity has been shown in cell wall formation in a diverse array of vascular plants, including club mosses, ferns, gymnosperms, monocots, and dicots. Vissenberg, K. et al. *J. Exp Bot* 54 (381):335-44 (2003). In addition to its role during primary cell wall formation, an in situ XET activity assay in poplar stems has demonstrated XET activity in xylem and phloem fibers during secondary wall formation. Borquin, N. *Plant Cell* 14(12): 3073-88 (2002).

Xyloglucan Synthase: xyloglucan synthase is an enzyme system of xyloglucan 4-glucosyltransferase and xyloglucan 6-xylosyltransferase. Xyloglucan synthase catalyses the formation of xyloglucan from UDP-xylose and UDP-glucose, concurrent transfers of glucose and xylose are necessary for this synthesis. Xyloglucan 6-xylosyltransferase transfers an α-D-xylosyl residue from UDP-D-xylose to a glucose residue in xyloglucan, forming an α-1,6-D-xylosyl-D-glucose linkage. Xyloglucan 4-glucosyltransferase, transfers a β-D-glucosyl residue from UDP-glucose on to a glucose residue in xyloglucan, forming a β-1,4-D-glucosyl-D-glucose linkage (Hayashi, T. and Matsuda, K. J. Biol. Chem. 256 (1981) 11117-11122, Hayashi, T. and Matsuda, K. Plant Cell Physiol. 22 (1981) 517-523).

Yieldin is a cell wall protein that regulates the yield threshold of the cell wall. Okamoto-Nakazato A. *Plant Res.* 115(4): 309-13 (2002). Yieldin is believed to play a role in regulating cell wall yielding during elongation growth. For example, it has been shown that yieldin is differentially expressed during cell elongation in etiolated cowpea seedlings; yieldin localizes to areas of elongation and disappears with the ceasing of cell elongation. Okamoto-Nakazato A et al. *Plant Cell Physiol.* 42(9):952-8 (2001).

It is understood that the present invention is not limited to the particular methodology, protocols, vectors, and reagents, etc., described herein, as these may vary. It is also to be understood that the terminology used herein is used for the purpose of describing particular embodiments only, and is not intended to limit the scope of the present invention. It must be noted that as used herein and in the appended claims, the singular forms "a," "an," and "the" include plural reference unless the context clearly dictates otherwise. Thus, for example, a reference to "a gene" is a reference to one or more genes and includes equivalents thereof known to those skilled in the art and so forth. Indeed, one skilled in the art can use the methods described herein to express any native gene (known presently or subsequently) in plant host systems.

Polynucleotide Sequences

The present invention relates to an isolated nucleic molecule comprising a polynucleotide having a sequence selected from the group consisting of any of the polynucleotide sequences of SEQ ID NOs: 1-230. The invention also provides functional fragments of the polynucleotide sequences of SEQ ID NOs: 1-230. The invention further provides complementary nucleic acids, or fragments thereof, to any of the polynucleotide sequences of SEQ ID NOs: 1-230, as well as a nucleic acid, comprising at least 15 contiguous bases, which hybridizes to any of the polynucleotide sequences of SEQ ID NOs: 1-230.

The present invention also relates to an isolated polypeptide sequence comprising a polypeptide having a sequence selected from the group consisting of any of the polypeptide sequences of SEQ ID NOs: 231-460. The invention also provides functional fragments of the polypeptide sequences of SEQ ID NOs: 231-460.

By "isolated" nucleic acid molecule(s) is intended a nucleic acid molecule, DNA or RNA, which has been removed from its native environment. For example, recombinant DNA molecules contained in a DNA construct are considered isolated for the purposes of the present invention. Further examples of isolated DNA molecules include recombinant DNA molecules maintained in heterologous host cells or purified (partially or substantially) DNA molecules in solution. Isolated RNA molecules include in vitro RNA transcripts of the DNA molecules of the present invention. Isolated nucleic acid molecules, according to the present invention, further include such molecules produced synthetically.

Nucleic acid molecules of the present invention may be in the form of RNA, such as mRNA, or in the form of DNA, including, for instance, cDNA and genomic DNA obtained by cloning or produced synthetically. The DNA or RNA may be double-stranded or single-stranded. Single-stranded DNA may be the coding strand, also known as the sense strand, or it may be the non-coding strand, also referred to as the antisense strand.

Unless otherwise indicated, all nucleotide sequences determined by sequencing a DNA molecule herein were determined using an automated DNA sequencer (such as the Model 373 from Applied Biosystems, Inc.) and all amino acid sequences of polypeptides encoded by DNA molecules determined herein were predicted by translation of a DNA sequence determined as above. Therefore, as is known in the art for any DNA sequence determined by this automated approach, any nucleotide sequence determined herein may contain some errors. Nucleotide sequences determined by automation are typically at least about 95% identical, more typically at least about 96% to at least about 99.9% identical to the actual nucleotide sequence of the sequenced DNA molecule. The actual sequence can be more precisely determined by other approaches including manual DNA sequencing methods well known in the art. As is also known in the art, a single insertion or deletion in a determined nucleotide sequence compared to the actual sequence will cause a frame shift in translation of the nucleotide sequence such that the predicted amino acid sequence encoded by a determined nucleotide sequence may be completely different from the amino acid sequence actually encoded by the sequenced DNA molecule, beginning at the point of such an insertion or deletion.

Each "nucleotide sequence" set forth herein is presented as a sequence of deoxyribonucleotides (abbreviated A, G, C and T). However, by "nucleotide sequence" of a nucleic acid molecule or polynucleotide is intended, for a DNA molecule or polynucleotide, a sequence of deoxyribonucleotides, and for an RNA molecule or polynucleotide, the corresponding sequence of ribonucleotides (A, G, C and U) where each thymidine deoxynucleotide (T) in the specified deoxynucleotide sequence in is replaced by the ribonucleotide uridine (U).

The present invention is also directed to fragments of the isolated nucleic acid molecules described herein. By a fragment of an isolated DNA molecule having the polynucleotide sequences shown in of SEQ ID NOs: 461-690 is intended DNA fragments at least 15 nucleotides, and more preferably at least 20 nucleotides, still more preferably at least 30 nucleotides in length, which are useful as diagnostic probes and primers is discussed in more detail below. Of course larger nucleic acid fragments of up to the entire length of the nucleic acid molecules of the present invention are also useful diagnostically as probes, according to conventional hybridization techniques, or as primers for amplification of a target sequence by the polymerase chain reaction (PCR), as described, for instance, in Molecular Cloning, A Laboratory Manual, 3rd. edition, edited by Sambrook & Russel., (2001), Cold Spring Harbor Laboratory Press, the entire disclosure of which is hereby incorporated herein by reference. By a fragment at least 20 nucleotides in length, for example, is intended fragments which include 20 or more contiguous bases from the nucleotide sequence of SEQ ID NOs: 1-230. The nucleic acids containing the nucleotide sequences listed in SEQ ID NOs: 1-230 can be generated using conventional methods of DNA synthesis which will be routine to the skilled artisan. For example, restriction endonuclease cleavage or shearing by sonication could easily be used to generate fragments of various sizes. Alternatively, the DNA fragments of the present invention could be generated synthetically according to known techniques.

In another aspect, the invention provides an isolated nucleic acid molecule comprising a polynucleotide which hybridizes under stringent hybridization conditions to a portion of the polynucleotide in a nucleic acid molecule of the invention described above. By a polynucleotide which hybridizes to a "portion" of a polynucleotide is intended a polynucleotide (either DNA or RNA) hybridizing to at least about 15 nucleotides, and more preferably at least about 20 nucleotides, and still more preferably at least about 30 nucleotides, and even more preferably more than 30 nucleotides of the reference polynucleotide. These fragments that hybridize to the reference fragments are useful as diagnostic probes and primers. A probe, as used herein is defined as at least about 100 contiguous bases of one of the nucleic acid sequences set forth in of SEQ ID NOs: 1-230. For the purpose of the invention, two sequences hybridize when they form a double-stranded complex in a hybridization solution of 6×SSC, 0.5% SDS, 5×Denhardt's solution and 100 µg of non-specific carrier DNA. See Ausubel et al., section 2.9, supplement 27 (1994). Sequences may hybridize at "moderate stringency," which is defined as a temperature of 60° C. in a hybridization solution of 6×SSC, 0.5% SDS, 5×Denhardt's solution and 100 µg of non-specific carrier DNA. For "high stringency" hybridization, the temperature is increased to 68° C. Following the moderate stringency hybridization reaction, the nucleotides are washed in a solution of 2×SSC plus 0.05% SDS for five times at room temperature, with subsequent washes with 0.1×SSC plus 0.1% SDS at 60° C. for 1 h. For high stringency, the wash temperature is increased to 68° C. For the purpose of the invention, hybridized nucleotides are those that are detected using 1 ng of a radiolabeled probe having a specific radioactivity of 10,000 cpm/ng, where the hybridized nucleotides are clearly visible following exposure to X-ray film at −70° C. for no more than 72 hours.

The present application is directed to such nucleic acid molecules which are at least 60%, 65%, 70%, 75%, 80%, 85%, 90%, 95%, 96%, 97%, 98%, 99% or 100% identical to a nucleic acid sequence described in of SEQ ID NOs: 1-230. Preferred, however, are nucleic acid molecules which are at least 95%, 96%, 97%, 98%, 99% or 100% identical to the nucleic acid sequence shown in of SEQ ID NOs: 1-230. Differences between two nucleic acid sequences may occur at the 5' or 3' terminal positions of the reference nucleotide sequence or anywhere between those terminal positions, interspersed either individually among nucleotides in the reference sequence or in one or more contiguous groups within the reference sequence.

As a practical matter, whether any particular nucleic acid molecule is at least 95%, 96%, 97%, 98% or 99% identical to a reference nucleotide sequence refers to a comparison made between two molecules using standard algorithms well known in the art and can be determined conventionally using publicly available computer programs such as the BLASTN algorithm. See Altschul et al., *Nucleic Acids Res.* 25:3389-3402 (1997).

Polynucleotides may be analyzed using the BLASTX algorithm, which compares the six-frame conceptual translation products of a nucleotide query sequence (both strands) against a protein sequence database. The similarity of polypeptide sequences may be examined using the BLASTP algorithm. The BLASTN, BLASTX and BLASTP programs are available from the National Center for Biotechnology Information (NCBI) National Library of Medicine, Building 38A, Room 8N805, Bethesda, Md. 20894, USA. The BLASTN algorithm Version 2.0.4 [Feb. 24, 1998] and Version 2.0.6 [Sep. 16, 1998], set to the default parameters described in the documentation and distributed with the algorithm, are preferred for use in the determination of polynucleotide variants according to the present invention. The BLASTP algorithm, is preferred for use in the determination of polypeptide variants according to the present invention. The computer algorithm FASTA is available from the University of Virginia by contacting David Hudson, Assistance Provost for Research, University of Virginia, PO Box 9025, Charlottesville, Va. Version 2.0u4 [February 1996], set to the default parameters described in the documentation and distributed with the algorithm, may be used in the determination of variants according to the present invention. The use of the FASTA algorithm is described in Pearson and Lipman, *Proc. Natl. Acad. Sci. USA* 85:2444-2448, 1988; and Pearson, *Methods in Enzymol.* 183:63-98, 1990.

The following running parameters are preferred for determination of alignments and similarities using BLASTN that contribute to the E values and percentage identity for polynucleotide sequences: Unix running command: blastall -p blastn -d embldb -e 10 -G0 -E0 -r 1 -v 30 -b 30 -i queryseq -o results; the parameters are: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -r Reward for a nucleotide match (blastn only) [Integer]; -v Number of one-line descriptions (V) [Integer]; -b Number of alignments to show (B) [Integer]; -i Query File [File In]; and -o BLAST report Output File [File Out] Optional.

The following running parameters are preferred for determination of alignments and similarities using BLASTP that contribute to the E values and percentage identity of polypeptide sequences; blastall -p blastp -d swissprotdb -e 10 -G 0 -E 0 -v 30 -b 30 -i queryseq -o results; wherein the parameters are: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -v Number of one-line descriptions (v) [Integer]; -b Number of alignments to show (b) [Integer]; -I Query File [File In]; -o BLAST report Output File [File Out] Optional.

The "hits" to one or more database sequences by a queried sequence produced by BLASTN, FASTA, BLASTP or a similar algorithm, align and identify similar portions of sequences. The hits are arranged in order of the degree of similarity and the length of sequence overlap. Hits to a database sequence generally represent an overlap over only a fraction of the sequence length of the queried sequence.

The BLASTN, FASTA and BLASTP algorithms also produce "Expect" values for alignments. The Expect value (E) indicates the number of hits one can "expect" to see over a certain number of contiguous sequences by chance when searching a database of a certain size. The Expect value is used as a significance threshold for determining whether the hit to a database, such as the preferred EMBL database, indicates true similarity. For example, an E value of 0.1 assigned to a polynucleotide hit is interpreted as meaning that in a database of the size of the EMBL database, one might expect to see 0.1 matches over the aligned portion of the sequence with a similar score simply by chance. By this criterion, the aligned and matched portions of the polynucleotide sequences then have a probability of 90% of being the same. For sequences having an E value of 0.01 or less over aligned and matched portions, the probability of finding a match by chance in the EMBL database is 1% or less using the BLASTN or FASTA algorithm.

According to one embodiment, "variant" polynucleotides and polypeptides, with reference to each of the polynucleotides and polypeptides of the present invention, preferably comprise sequences having the same number or fewer nucleic or amino acids than each of the polynucleotides or polypeptides of the present invention and producing an E value of 0.01 or less when compared to the polynucleotide or polypeptide of the present invention. That is, a variant polynucleotide or polypeptide is any sequence that has at least a 99% probability of being the same as the polynucleotide or polypeptide of the present invention, measured as having an E value of 0.01 or less using the BLASTN, FASTA, or BLASTP algorithms set at parameters described above.

Alternatively, variant polynucleotides of the present invention hybridize to the polynucleotide sequences recited in of SEQ ID NOs: 1-230, or complements, reverse sequences, or reverse complements of those sequences, under stringent conditions.

The present invention also encompasses polynucleotides that differ from the disclosed sequences but that, as a consequence of the degeneracy of the genetic code, encode a polypeptide which is the same as that encoded by a polynucleotide of the present invention. Thus, polynucleotides comprising sequences that differ from the polynucleotide sequences recited in of SEQ ID NOs: 1-230; or complements, reverse sequences, or reverse complements thereof, as a result of conservative substitutions are contemplated by and encompassed within the present invention. Additionally, polynucleotides comprising sequences that differ from the polynucleotide sequences recited in of SEQ ID NOs: 1-230, or complements, reverse complements or reverse sequences thereof, as a result of deletions and/or insertions totaling less than 10% of the total sequence length are also contemplated by and encompassed within the present invention. Similarly, polypeptides comprising sequences that differ from the polypeptide sequences recited in of SEQ ID NOs: 231-460, as a result of amino acid substitutions, insertions, and/or deletions totaling less than 10% of the total sequence length are contemplated by and encompassed within the present invention. In certain embodiments, variants of the inventive polypeptides possess biological activities that are the same or similar to those of the inventive polypeptides. Such variant polypeptides function during cell wall biosynthesis and development and/or wood development.

In addition to having a specified percentage identity to an inventive polynucleotide or polypeptide sequence, variant polynucleotides and polypeptides preferably have additional structure and/or functional features in common with the inventive polynucleotide or polypeptide. Polypeptides having a specified degree of identity to a polypeptide of the present invention share a high degree of similarity in their primary structure and have substantially similar functional properties. In addition to sharing a high degree of similarity in their primary structure to polynucleotides of the present invention, polynucleotides having a specified degree of identity to, or capable of hybridizing to an inventive polynucleotide preferably have at least one of the following features: (i) they contain an open reading frame or partial open reading frame encoding a polypeptide having substantially the same functional properties as the polypeptide encoded by the inventive polynucleotide; or (ii) they have domains in common.

Promoters

The polynucleotides of the present invention can be used for specifically directing the expression of polypeptides or proteins in the tissues of plants. The nucleic acids of the present invention can also be used for specifically directing the expression of antisense RNA, or RNA involved in RNA interference (RNAi) such as small interfering RNA (siRNA), in the tissues of plants, which can be useful for inhibiting or completely blocking the expression of targeted genes. As used herein, vascular plant tissue refers to xylem, phloem or vascular cambium tissue. Preferably, the promoters of the invention are either "xylem-preferred," "cambium-preferred" or "phloem-preferred" and direct expression of an operably linked nucleic acid segment in the xylem, cambium or phloem, respectively. As used herein, "coding product" is intended to mean the ultimate product of the nucleic acid that is operably linked to the promoters. For example, a protein or polypeptide is a coding product, as well as antisense RNA or siRNA which is the ultimate product of the nucleic acid coding for the antisense RNA. The coding product may also be non-translated mRNA. The terms polypeptide and protein are used interchangeably herein. Xylem-preferred, for example, is intended to mean that the nucleic acid molecules of the current invention are more active in the xylem than in any other plant tissue. Most preferably, the nucleic acids of the current invention are promoters that are active specifically in the xylem, cambium or phloem, meaning that the promoters are only active in the xylem, cambium or phloem tissue of plants, respectively. In other words, a "xylem-specific" promoter, for example, drives the expression of a coding product such that detectable levels of the coding product are expressed only in xylem tissue of a plant. However, because of solute transport in plants, the coding product that is specifically expressed in the xylem, phloem or cambium may be found anywhere in the plant and thus its presence is not necessarily confined to xylem tissue. A vascular-preferred promoter, on the other hand can be preferentially active is any of the xylem, phloem or cambium tissues, or in at least two of the three tissue types. A vascular-specific promoter is specifically active in any of the xylem, phloem or cambium, or in at least two of the three.

As used herein, promoter is intended to mean a nucleic acid, preferably DNA that binds RNA polymerase and/or other transcription regulatory elements. As with any promoter, the promoters of the current invention will facilitate or control the transcription of DNA or RNA to generate an mRNA molecule from a nucleic acid molecule that is operably linked to the promoter. The RNA may code for a protein or polypeptide or may code for an RNA interfering, or antisense molecule. As used herein, "operably linked" is meant to refer to the chemical fusion, ligation, or synthesis of DNA such that a promoter-nucleic acid sequence combination is formed in a proper orientation for the nucleic acid sequence to be transcribed into an RNA segment. The promoters of the current invention may also contain some or all of the 5' untranslated region (5' UTR) of the resulting mRNA transcript. On the other hand, the promoters of the current invention do not necessarily need to possess any of the 5' UTR.

A promoter, as used herein, may also include regulatory elements. Conversely, a regulatory element may also be separate from a promoter. Regulatory elements confer a number of important characteristics upon a promoter region. Some elements bind transcription factors that enhance the rate of transcription of the operably linked nucleic acid. Other elements bind repressors that inhibit transcription activity. The effect of transcription factors on promoter activity may determine whether the promoter activity is high or low, i.e. whether the promoter is "strong" or "weak."

In another embodiment, a constitutive promoter may be used for expressing the inventive polynucleotide sequences. Examples of constitutive plant promoters which may be useful for expressing a cell wall or wood biosynthesis gene: the cauliflower mosaic virus (CaMV) 35S promoter, which confers constitutive, high-level expression in most plant tissues (Odel et al. Nature 313:810 (1985)); the nopaline synthase promoter (An et al. Plant Physiol. 88:547 (1988)); and the octopine synthase promoter (Fromm et al., Plant Cell 1: 977 (1989)).

In another embodiment, a variety of inducible plant gene promoters can be used for expressing the inventive polynucleotide sequences. Inducible promoters regulate gene expression in response to environmental, hormonal, or chemical signals. Examples of hormone inducible promoters include auxin-inducible promoters (Baumann et al. Plant Cell 11:323-334(1999)), cytokinin-inducible promoter (Guevara-Garcia Plant Mol. Biol. 38:743-753 (1998)), and gibberellin-responsive promoters (Shi et al. Plant Mol. Biol. 38:1053-1060 (1998)). Additionally, promoters responsive to heat, light, wounding, pathogen resistance, and chemicals such as methyl jasmonate or salicylic acid, may be used for expressing the inventive polynucleotide sequences.

DNA Constructs

The present invention provides DNA constructs comprising the isolated nucleic acid molecules and polypeptide sequences of the present invention. In one embodiment, the DNA constructs of the present invention are Ti-plasmids derived from A. tumefaciens.

In developing the nucleic acid constructs of this invention, the various components of the construct or fragments thereof will normally be inserted into a convenient cloning vector, e.g., a plasmid that is capable of replication in a bacterial host, e.g., E. coli. Numerous vectors exist that have been described in the literature, many of which are commercially available. After each cloning, the cloning vector with the desired insert may be isolated and subjected to further manipulation, such as restriction digestion, insertion of new fragments or nucleotides, ligation, deletion, mutation, resection, etc. to tailor the components of the desired sequence. Once the construct has been completed, it may then be transferred to an appropriate vector for further manipulation in accordance with the manner of transformation of the host cell.

A recombinant DNA molecule of the invention typically includes a selectable marker so that transformed cells can be easily identified and selected from non-transformed cells. Examples of such markers include, but are not limited to, a neomycin phosphotransferase (nptII) gene (Potrykus et al., Mol. Gen. Genet. 199:183-188 (1985)), which confers kanamycin resistance. Cells expressing the nptII gene can be selected using an appropriate antibiotic such as kanamycin or G418. Other commonly used selectable markers include the bar gene, which confers bialaphos resistance; a mutant EPSP synthase gene (Hinchee et al., Bio/Technology 6:915-922 (1988)), which confers glyphosate resistance; and a mutant acetolactate synthase gene (ALS), which confers imidazolinone or sulphonylurea resistance (European Patent Application 154,204, 1985).

Additionally, vectors may include an origin of replication (replicons) for a particular host cell. Various prokaryotic replicons are known to those skilled in the art, and function to direct autonomous replication and maintenance of a recombinant molecule in a prokaryotic host cell.

The vectors will preferably contain selectable markers for selection in plant cells. Numerous selectable markers for use in selecting transfected plant cells including, but not limited to, kanamycin, glyphosate resistance genes, and tetracycline or ampicillin resistance for culturing in E. coli, A. tumefaciens and other bacteria.

For secretion of the translated protein into the lumen of the endoplasmic reticulum, the periplasmic space or into the extracellular environment, appropriate secretion signals may be incorporated into the expressed polypeptide. The signals may be endogenous to the polypeptide or they may be heterologous signals.

In one embodiment, a DNA construct of the current invention is designed in a manner such that a polynucleotide sequence described herein is operably linked to a tissue-specific promoter. Preferably, the polynucleotide encodes a polypeptide involved in wood or cell wall biosynthesis. Polynucleotides encoding many of the enzymes involved in wood or cell wall biosynthesis include, but are not limited to, cinnamyl alcohol dehydrogenase (CAD), cinnamate 4-hydroxylase (C4H), coumarate 3-hydroxylase (C3H), phenolase (PNL), O-methyl transferase (OMT), cinnamoyl-CoA reductase (CCR), phenylalanine ammonia-lyase (PAL), 4-coumarate: CoA ligase (4CL) and peroxidase (POX) from pine. U.S. Pat. No. 6,204,434. Other enzymes include coniferin β-glucosidase (CBG), and caffeic acid 3-O-methyltransferase (COMT). U.S. Pat. No. 5,451,514, WO 94/23044, and Dharmawardhana et al., Plant Mol. Biol. 40: 365-72 (1999).

In another embodiment, the coding sequence operably linked to the promoter may code for a gene product that inhibits the expression or activity of enzymes involved in wood or cell wall biosynthesis. For example, of particular interest for control of lignin biosynthesis is an antisense gene encoding a 4CL, CAD, LIM, TED2, or a COMT.

In a further embodiment, the DNA constructs of the current invention are designed such that the polynucleotide sequences of the current invention are operably linked to DNA or RNA that encodes antisense RNA or interfering RNA, which corresponds to genes that code for polypeptides of interest, resulting in a decreased expression of targeted gene products. Preferably the gene products targeted for suppression are enzymes involved in lignin biosynthesis. The use of RNAi inhibition of gene expression is described in U.S. Pat. No. 6,506,559, and the use of RNAi to inhibit gene expression in plants is specifically described in WO 99/61631, both of which are herein incorporated by reference.

The use of antisense technology to reduce or inhibit the expression of specific plant genes has been described, for example in European Patent Publication No. 271988. Reduction of gene expression led to a change in the phenotype of the plant, either at the level of gross visible phenotypic difference, for example a lack of lycopene synthesis in the fruit of tomato leading to the production of yellow rather than red fruit, or at a more subtle biochemical level, for example, a change in the amount of polygalacturonase and reduction in depolymerisation of pectins during tomato fruit ripening (Smith et. al., Nature, 334:724-726 (1988); Smith et. al., Plant Mol. Biol., 14:369-379 (1990)). Thus, antisense RNA has been demonstrated to be useful in achieving reduction of gene expression in plants.

In one embodiment an inventive polynucleotide sequence is capable of being transcribed inside a plant to yield an antisense RNA transcript is introduced into the plant, e.g., into a plant cell. The inventive polynucleotide can be prepared, for example, by reversing the orientation of a gene sequence with respect to its promoter. Transcription of the exogenous DNA in the plant cell generates an intracellular RNA transcript that is "antisense" with respect to that gene.

The invention also provides host cells which comprise the DNA constructs of the current invention. As used herein, a host cell refers to the cell in which the coding product is ultimately expressed. Accordingly, a host cell can be an individual cell, a cell culture or cells as part of an organism. The host cell can also be a portion of an embryo, endosperm, sperm or egg cell, or a fertilized egg.

Accordingly, the present invention also provides plants or plant cells, comprising the DNA constructs of the current invention. Preferably the plants are angiosperms or gymnosperms. The expression construct of the present invention may be used to transform a variety of plants, both monocotyledonous (e.g. grasses, corn, grains, oat, wheat and barley), dicotyledonous (e.g., *Arabidopsis*, tobacco, legumes, alfalfa, oaks, eucalyptus, maple), and Gymnosperms (e.g., Scots pine; see Aronen, *Finnish Forest Res. Papers*, Vol. 595, 1996), white spruce (Ellis et al., *Biotechnology* 11:84-89, 1993), and larch (Huang et al., *In Vitro Cell* 27:201-207, 1991).

In a preferred embodiment, the inventive expression vectors are employed to transform woody plants, herein defined as a tree or shrub whose stem lives for a number of years and increases in diameter each year by the addition of woody tissue. Preferably the target plant is selected from the group consisting of eucalyptus and pine species, most preferably from the group consisting of *Eucalyptus grandis* and its hybrids, and *Pinus taeda*. Also preferred, the target plant is selected from the group consisting of *Pinus banksiana, Pinus brutia, Pinus caribaea, Pinus clasusa, Pinus contorta, Pinus coulteri, Pinus echinata, Pinus eldarica, Pinus ellioti, Pinus jeffreyi, Pinus lambertiana, Pinus massoniana, Pinus monticola, Pinus nigra, Pinus palustrus, pinus pinaster, Pinus ponderosa, Pinus radiata, Pinus resinosa, Pinus rigida, Pinus serotina, Pinus strobus, Pinus sylvestris, Pinus taeda, Pinus virginiana, Abies amabilis, Abies balsamea, Abies concolor, Abies grandis, Abies lasiocarpa, Abies magnifica, Abies procera, Chamaecyparis lawsoniona, Chamaecyparis nootkatensis, Chamaecyparis thyoides, Juniperus virginiana, Larix decidua, Larix laricina, Larix leptolepis, Larix occidentalis, Larix siberica, Libocedrus decurrens, Picea abies, Picea engelmanni, Picea glauca, Picea mariana, Picea pungens, Picea rubens, Picea sitchensis, Pseudotsuga menziesii, Sequoia gigantea, Sequoia sempervirens, Taxodium distichum, Tsuga canadensis, Tsuga heterophylla, Tsuga mertensiana, Thuja occidentalis, Thuja plicata, Eucalyptus alba, Eucalyptus bancroftii, Eucalyptus botryoides, Eucalyptus bridgesiana, Eucalyptus calophylla, Eucalyptus camaldulensis, Eucalyptus citriodora, Eucalyptus cladocalyx, Eucalyptus coccifera, Eucalyptus curtisil, Eucalyptus dalrympleana, Eucalyptus deglupta, Eucalyptus delagatensis, Eucalyptus diversicolor, Eucalyptus dunnii, Eucalyptus ficifolia, Eucalyptus globulus, Eucalyptus gomphocephala, Eucalyptus gunnii, Eucalyptus henryi, Eucalyptus laevopinea, Eucalyptus macarthurii, Eucalyptus macrorhyncha, Eucalyptus maculata, Eucalyptus marginata, Eucalyptus megacarpa, Eucalyptus melliodora, Eucalyptus nicholii, Eucalyptus nitens, Eucalyptus nova-angelica, Eucalyptus obliqua, Eucalyptus occidentalis Eucalyptus obtusiflora, Eucalyptus oreades, Eucalyptus pauciflora, Eucalyptus polybractea, Eucalyptus regnans, Eucalyptus resinifera, Eucalyptus robusta, Eucalyptus rudis, Eucalyptus saligna, Eucalyptus sideroxylon, Eucalyptus stuartiana, Eucalyptus tereticornis, Eucalyptus torelliana, Eucalyptus urnigera, Eucalyptus urophylla, Eucalyptus viminalis, Eucalyptus viridis, Eucalyptus wandoo*, and *Eucalyptus youmanni*.

In particular, the transgenic plant may be of the species *Eucalyptus grandis* or its hybrids, *Pinus radiata, Pinus taeda* L (loblolly pine), *Populus nigra, Populus deltoides, Populus alba*, or *Populus* hybrids, *Acacia mangium*, or *Liquidamber styraciflua*. Beyond the ordinary meaning of plant, the term "plants" is also intended to mean the fruit, seeds, flower, strobilus etc. of the plant. The plant of the current invention may be a direct transfectant, meaning that the DNA construct was introduced directly into the plant, such as through *Agrobacterium*, or the plant may be the progeny of a transfected plant. The second or subsequent generation plant may or may not be produced by sexual reproduction, i.e., fertilization. Furthermore, the plant can be a gametophyte (haploid stage) or a sporophyte (diploid stage).

In one embodiment, the present invention provides isolated polynucleotides encoding, or partially encoding, plant wood and cell wall proteins that are involved in cell wall biosynthesis. The polynucleotides of the present invention were isolated from *Eucalyptus grandis* and *Pinus radiata*, but may be isolated from any plant species or synthesized using conventional synthesis techniques.

In specific embodiments, isolated polynucleotides of the present invention comprise a sequence selected from the group consisting of sequences identified as SEQ ID NOS: 1-230 complements of the sequences identified as SEQ ID NOS: 1-230; reverse complements of the sequences identified as SEQ ID NOS: 1-230, reverse sequences of the sequences identified as SEQ ID NOS: 1-230; sequences comprising at least a specified number of contiguous residues (x-mers) of any of the above-mentioned polynucleotides; extended sequences corresponding to any of the above polynucleotides; antisense sequences corresponding to any of the above polynucleotides; and variants of any of the above polynucleotides, as that term is described in this specification.

In another aspect, the present invention provides isolated polypeptides encoded by the polynucleotides of SEQ ID NOS: 231-460.

*Eucalyptus grandis* and *Pinus radiata* cDNA expression libraries were prepared from mature shoot buds, early wood phloem, floral tissue, leaf tissue, feeder roots, structural roots, xylem or early wood xylem. cDNA sequence from positive clones containing inserts were obtained using methods known in the art. The determined cDNA sequences were compared with known sequences in the public databases (EMBL) using the computer algorithms FASTA and/or BLASTN. Multiple alignments of redundant sequences were used to build reliable consensus sequences. The determined cDNA sequences are provided in SEQ ID NOS: 1-230. The predicted polypeptide sequences are provided in SEQ ID NOS: 231-460.

Based on similarity to known sequences from other plant species, the isolated polynucleotide sequences were identified as encoding wood and cell wall proteins, as detailed in Tables 1 and 2. The polypeptide sequences were analyzed with publicly available annotation software. EMBL's publicly available "InterPro Scan" was used for identifying motifs and domains in the present polypeptide sequences. InterPro is a database of protein families, domains and functional sites in which identifiable features found in known proteins can be applied to unknown protein sequences. Mulder, N. J. et al. 2003, *Nucl Acid Res*. 31: 315-318.

As shown in Tables 1 and 2, the polynucleotides of the invention encode wood and cell wall proteins. These polynucleotides can be used for regulating cell wall biosynthesis and development.

TABLE 1

Cell Wall Proteins isolated from *P. radiata*

| Protein Family | Polynucleotide SEQ ID NO | Polypeptide SEQ ID NO |
|---|---|---|
| 1,3-beta-D-glucanase | 3-29 | 233-259 |
| Alpha-expansin | 111-130 | 341-360 |
| Calnexin | 1-2 | 231-232 |
| Dirigent | 91-110 | 321-340 |
| Endo-1,4-beta-xylanase | 30 | 260 |
| Exo-1,4-beta-xylanase | 31-37 | 261-267 |
| Glucan 1,3-beta-glucosidase | 38-44 | 268-274 |
| Licheninase | 45-52 | 275-282 |
| Mannose-6-Phosphate Isomerase | 58 | 288 |
| Mannose-1-Phosphate Guanylyltransferase | 53-57 | 283-287 |
| Sucrose-phosphate synthase | 59-60 | 289-290 |
| Xyloglucan: xyloglucosyl transferase | 61-90 | 291-320 |
| Yieldin | 131 | 361 |

TABLE 2

Wood and Cell Wall Proteins isolated from *E. grandis*

| Protein Family | Polynucleotide SEQ ID NO | Polypeptide SEQ ID NO |
|---|---|---|
| 1,3-beta-D-glucanase | 142-158 | 372-388 |
| Alpha-expansin | 217-228 | 447-458 |
| Calnexin | 132-136 | 362-366 |
| Dirigent | 208-216 | 438-446 |
| Endo-1,4-beta-xylanase | 159-161 | 389-391 |
| Exo-1,4-beta-xylanase | 162-165 | 392-395 |
| Glucan 1,3-beta-glucosidase | 166-172 | 396-402 |
| Licheninase | 173-179 | 403-409 |
| Mannose-6-Phosphate Isomerase | 183 | 413 |
| Mannose-1-Phosphate Guanylyltransferase | 180-182 | 410-412 |
| Sucrose-phosphate synthase | 184-186 | 414-416 |
| Sucrose synthase | 137-141 | 367-371 |
| Xyloglucan: xyloglucosyl transferase | 187-207 | 417-437 |
| Yieldin | 229-230 | 459-460 |

Polypeptides encoded by the polynucleotides of the present invention may be expressed and used in various assays to determine their biological activity. Such polypeptides may be used to raise antibodies, to isolate corresponding interacting proteins or other compounds, and to quantitatively determine levels of interacting proteins or other compounds.

Plant Transformation and Regeneration

The present polynucleotides and polypeptides may be introduced into a host plant cell by standard procedures known in the art for introducing recombinant sequences into a target host cell. Such procedures include, but are not limited to, transfection, infection, transformation, natural uptake, electroporation, biolistics and *Agrobacterium*. Methods for introducing foreign genes into plants are known in the art and can be used to insert a construct of the invention into a plant host, including, biological and physical plant transformation protocols. See, for example, Miki et al., 1993, "Procedure for Introducing Foreign DNA into Plants", In: Methods in Plant Molecular Biology and Biotechnology, Glick and Thompson, eds., CRC Press, Inc., Boca Raton, pages 67-88. The methods chosen vary with the host plant, and include chemical transfection methods such as calcium phosphate, microorganism-mediated gene transfer such as *Agrobacterium* (Horsch et al., Science 227:1229-31, 1985), electroporation, micro-injection, and biolistic bombardment.

Accordingly, the present invention also provides plants or plant cells, comprising the polynucleotides or polypeptides of the current invention. In one embodiment, the plants are angiosperms or gymnosperms. In another embodiment, the plants are selected from *Eucalyptus* and *Pinus* species. In particular, the transgenic plant may be of the species *Eucalyptus grandis* and hybrids, *Pinus radiata, Pinus taeda* L (loblolly pine), *Populus nigra, Populus deltoides*, or *Liquidamber styraciflua*. Beyond the ordinary meaning of plant, the term "plants" is also intended to mean the fruit, seeds, flower, strobilus etc. of the plant. The plant of the current invention may be a direct transfectant, meaning that the vector was introduced directly into the plant, such as through *Agrobacterium*, or the plant may be the progeny of a transfected plant. The progeny may also be obtained by asexual reproduction of a transfected plant. The second or subsequent generation plant may or may not be produced by sexual reproduction, i.e., fertilization. Furthermore, the plant can be a gametophyte (haploid stage) or a sporophyte (diploid stage).

Methods for transforming tree species are well known in the art. By no means limiting, explant refers to plant tissue that is a target for transformation and may include leaf, petiole, floral, and internodal tissues harvested from plants grown in vivo and/or in vitro. For example, a tree can be transformed as follows. For increased transformation efficiency, a tree explant can be harvested and cultured on a pre-culture medium before transformation. A pre-culture medium, as shown in Table 3, is a nutrient medium upon which plant explants are cultured before transformation with *Agrobacterium* and is needed for increasing transformation efficiency and plant regeneration. The pre-culture medium comprises an *Agrobacterium* inducer, such as acetosyringone. The pre-culture medium may optionally comprise plant growth regulators, including auxin and cytokinin. Alternatively, other pre-culture media and time periods of culture may be used.

TABLE 3

Plant Pre-Culture Medium

| Medium | Amount per Liter |
|---|---|
| WPM salts | 1 package (Sigma) |
| Ca(NO$_3$)$_2$•4H$_2$O | 3.7 g |
| MgSO$_4$•4H$_2$O | 0.37 g |
| Nicotinic Acid | 0.5 mg |
| Thiamine HCl | 0.5 mg |
| Pyridoxin HCl | 0.5 mg |
| D-Pantothenic Acid | 1.0 mg |
| Myo-inositol | 0.1 g |
| BA | 0.1-1 mg |
| Bacto-agar | 5-8 g |
| Acetosyringone | 5-200 mg |
| NAA | 0.2-3 mg |
| zeatin | 1-6 mg |

In the present invention, plant explants were pre-cultured for four days in the dark on the pre-culture medium displayed in Table 3. Woody Plant Medium (WPM) salts (Loyd and McCown, 1980) were used in the present pre-culture medium; however, other salt media, such as MS medium (Murashige and Skoog 1962) or Lepoivre medium, may be used. While the present pre-culture medium comprises acetosyringone, other *Agrobacterium* inducers may be used. Optionally, the instant pre-culture medium contained both auxin and cytokinin. Other pre-culture media and other culture time periods may be used.

Induced *Agrobacterium* culture was prepared by methods known in the art. The induced culture was dripped onto each explant by pipette. Sufficient *Agrobacterium* culture was dripped to ensure that all edges were covered with bacterial solution. Alternatively, the explants may be transformed by vacuum infiltration, floral dip, and other methods of *Agrobacterium*-mediated transformation. Following transformation, explants covered with *Agrobacterium* culture were placed in the dark for four days of co-cultivation. Alternatively, the explants may be co-cultivated with *Agrobacterium* under light conditions. Additionally, the explants may be co-cultivated with *Agrobacterium* under light or dark conditions for 2-10 days, preferably 4 days. Following co-cultivation, the explants were transferred to regeneration medium (Table 4) with 400 mg/l timentin. There is no need to wash explants. Explants were cultured on this medium for four days before transfer to a selection medium. In the present example, the selection medium is the regeneration medium supplemented with both timentin and an herbicide selection agent.

TABLE 4

Regeneration Medium

| Components for 1 Liter of Medium | Grams |
|---|---|
| $KNO_3$ | 1 |
| $NH_4H_2PO_4$ | 0.25 |
| $MgSO_4 \cdot 7H_2O$ | 0.25 |
| $CaCl_2 \cdot 2H_2O$ | 0.10 |
| $FeSO_4 \cdot 7H_2O$ | 0.0139 |
| $Na_2EDTA \cdot 2H_2O$ | 0.01865 |
| MES (Duchefa m1501) | 600.0 |
| MS Micro (½ strength) | |
| $MnSO_4 \cdot H_2O$ | 0.00845 |
| $ZnSO_4 \cdot 7H_2O$ | 0.0043 |
| $CuSO_4 \cdot 5H_2O$ | 0.0000125 |
| $CoCl_2 \cdot 6H_2O$ | 0.0000125 |
| KI | 0.000415 |
| $H_3BO_3$ | 0.0031 |
| $Na_2MoO_4 \cdot 2H_2O$ | 0.000125 |
| Zeatin | |
| NAA (naphthalene acetic acid) | |
| Glucose/Sucrose | 20.0 |
| Myo-inositol | 0.100 |
| Nicotinic Acid | 0.010 |
| Thiamine | 0.010 |
| Ca Pantothenate | 0.001 |
| Pyridoxine | 0.001 |
| Biotin | 0.00001 |
| Ascorbic Acid | 0.050 |
| L-glutamine | 0.1 |
| Arginine | 0.0258 |
| Glycine | 0.00199 |
| Lysine | 0.0508 |
| Methionine | 0.0132 |
| Phenylalanine | 0.0257 |
| Serine | 0.00904 |
| Threonine | 0.00852 |
| Tryptophan | 0.0122 |
| Tyrosine | 0.0127 |
| Gelrite | 3.0 |

Shoot clumps that survive selection are maintained on regeneration medium containing herbicide and timentin, and they are transferred every 3 weeks until shoots proliferate and initially elongate. For transformation experiments with a reporter gene, such as GUS, leaf and stem tissues from the regenerated shoots are stained for GUS expression as soon as the shoots are developed. While any reporter gene may be used, such as GFP or luciferase, GUS expression was assayed in the present invention by methods known in the art.

GUS staining was performed to monitor the frequency of *Agrobacterium* infection and to ensure that the selected shoots are not escapes or chimeras. Leaf and stem tissues from the regenerated shoots were stained for GUS expression immediately upon shoot development. To determine GUS activity, the explants were incubated in a substrate comprising 100 mM phosphate buffer (pH 7.0), 0.05% dimethyl suphoxide, 0.05% Triton X-100, 10 mM EDTA, 0.5 mM potassium ferrocyanide, and 1.5 mg/ml 5-bromo-4-chloro-3-indolyl-β-D-glucuronide (X-gluc). The explants were subjected to 10 minutes of vacuum before an overnight incubation at 37° C. Following overnight incubation, GUS foci were counted.

B. Expression Profiling of Plant Cell Wall Polynucleotides

The present invention also provides methods and tools for performing expression profiling of plant cell wall polynucleotides. Expression profiling is useful in determining whether polynucleotides are transcribed or translated, comparing transcript levels for particular polynucleotide in different tissues, genotyping, estimating DNA copy number, determining identity of descent, measuring mRNA decay rates, identifying protein binding sites; determining subcellular localization of gene products, correlating polynucleotide expression to a phenotype or other phenomenon, and determining the effect on other polynucleotides of the manipulation of a particular gene. Expression profiling is particularly useful for identifying polynucleotide expression in complex, multigenic events. For this reason, expression profiling is useful in correlating polynucleotide expression to plant phenotype and formation of plant.

Only a small fraction of the genes of a plant's genome are expressed at a given time in a given tissue sample, and all of the expressed genes may not affect the plant phenotype. To identify polynucleotides capable of affecting a phenotype of interest, the present invention provides methods and tools for determining, for example, a polynucleotide expression profile at a given point in plant development and a gene expression profile a given tissue sample. The invention also provides methods and tools for inventive polynucleotides whose expression can be manipulated to alter plant phenotype or to alter the biological activity of other transcription and translation products. In support of these methods, the invention also provides methods and tools that distinguish expression of different polynucleotides of the same family.

As used herein, "polynucleotide expression," refers to the process of transcription of a DNA sequence into an RNA sequence, followed by translation of the RNA into a protein, which may or may not undergo post-translational processing. Thus, the relationship between phenotype and/or developmental stage and polynucleotide expression can be observed by detecting, quantitatively or qualitatively, changes in the level of an RNA or a protein. As used herein, the term "biological activity" includes, but is not limited to, the activity of a protein gene product, including enzyme activity.

The present invention provides oligonucleotides that are useful in these expression profiling methods. Each oligonucleotide is capable of hybridizing under a given set of conditions to a cell wall or wood polynucleotide or polynucleotide product. In one aspect of the invention, a plurality of oligonucleotides is provided, wherein each oligonucleotide hybridizes under a given set of conditions to a different cell cycle gene product. Examples of oligonucleotides of the present invention include SEQ ID NOs 461-690. Each of the oligos of SEQ ID Nos: 461-690 hybridizes under standard conditions to a different gene product of one of SEQ ID NOs: 1-230. The oligonucleotides of the invention are useful in determining the expression of one or more cell cycle genes in any of the above-described methods.

1. Cell, Tissue, Nucleic Acid, and Protein Samples

Samples for use in methods of the present invention may be derived from plant tissue. Suitable plant tissues include, but are not limited to, somatic embryos, pollen, leaves, stems, calli, stolons, microtubers, shoots, xylem, male strolbili, pollen cones, vascular tissue, apical meristem, vascular cambium, xylem, root, flower, and seed.

According to the present invention "plant tissue" is used as described previously herein. Plant tissue can be obtained from any of the plants types or species described supra.

In accordance with one aspect of the invention, samples can be obtained from plant tissue at different developmental stages, from plant tissue at various times of the year (e.g. spring versus summer), from plant tissues subject to different environmental conditions (e.g. variations in light and temperature) and/or from different types of plant tissue and cells. In accordance with one embodiment, plant tissue is obtained during various stages of maturity and during different seasons of the year. For example, plant tissue can be collected from stem dividing cells, differentiating xylem, early developing wood cells, differentiated early wood cells, and differentiated late wood cells. As another example, polynucleotide expression in a sample obtained from a plant with developing wood can be compared to gene expression in a sample obtained from a plant which does not have developing wood.

Differentiating xylem includes samples obtained from compression wood, side-wood, and normal vertical xylem. Methods of obtaining samples for expression profiling from pine and eucalyptus are known. See, e.g., Allona et al., *Proc. Nat'l Acad. Sci.* 95:9693-8 (1998) and Whetton et al., *Plant Mol. Biol.* 47:275-91, and Kirst et al., INT'L UNION OF FORESTRY RESEARCH ORGANIZATIONS BIENNIAL CONFERENCE, S6.8 (June 2003, Umea, Sweden).

In one embodiment of the invention, polynucleotide expression in one type of tissue is compared to polynucleotide expression in a different type of tissue or to polynucleotide expression in the same type of tissue in a difference stage of development. Polynucleotide expression can also be compared in one type of tissue which is sampled at various times during the year (different seasons). For example, polynucleotide expression in juvenile secondary xylem can be compared to polynucleotide expression in mature secondary xylem. Similarly, polynucleotide expression in cambium can be compared to polynucleotide expression in xylem. Furthermore, gene expression in apical meristems can be compared to gene expression in cambium.

In another embodiment of the invention, a sample is obtained from a plant having a specific phenotype and polynucleotide expression in that sample is compared to a sample obtained from a plant of the same species that does not have that phenotype. For example, a sample can be obtained from a plant exhibiting a fast rate of growth and gene expression can be compared with that of a sample obtained from a plant exhibiting a normal or slow rate of growth. Differentially expressed polynucleotides identified from such a comparison can be correlated with growth rate and, therefore, useful for manipulating growth rate.

In a further embodiment, a sample is obtained from clonally propagated plants. In one embodiment the clonally propagated plants are of the species *Pinus* or *Eucalyptus*. Individual ramets from the same genotype can be sacrificed at different times of year. Thus, for any genotype there can be at least two genetically identical trees sacrificed, early in the season and late in the season. Each of these trees can be divided into juvenile (top) to mature (bottom) samples. Further, tissue samples can be divided into, for example, phloem to xylem, in at least 5 layers of peeling. Each of these samples can be evaluated for phenotype and polynucleotide expression.

Where cellular components may interfere with an analytical technique, such as a hybridization assay, enzyme assay, a ligand binding assay, or a biological activity assay, it may be desirable to isolate the polynucleotide expression products from such cellular components. Polynucleotide expression products, including nucleic acid and amino acid gene products, can be isolated from cell fragments or lysates by any method known in the art.

Nucleic acids used in accordance with the invention can be prepared by any available method or process, or by other processes as they become known in the art. Conventional techniques for isolating nucleic acids are detailed, for example, in Tijssen, LABORATORY TECHNIQUES IN BIOCHEMISTRY AND MOLECULAR BIOLOGY: HYBRIDIZATION WITH NUCLEIC ACID PROBES, chapter 3 (Elsevier Press, 1993), Berger and Kimmel, *Methods Enzymol.* 152:1 (1987), and GIBCO BRL & LIFE TECHNOLOGIES TRIZOL RNA ISOLATION PROTOCOL, Form No. 3786 (2000). Techniques for preparing nucleic acid samples, and sequencing polynucleotides from pine and eucalyptus are known. See, e.g., Allona et al., supra and Whetton et al., supra, and U.S. Application No. 60/476,222.

A suitable nucleic acid sample can contain any type of nucleic acid derived from the transcript of a cell wall or wood gene or polypeptide, i.e., RNA or a subsequence thereof or a nucleic acid for which an mRNA transcribed from a cell wall or wood gene served as a template. Suitable nucleic acids include cDNA reverse-transcribed from a transcript, RNA transcribed from that cDNA, DNA amplified from the cDNA, and RNA transcribed from the amplified DNA. Detection of such products or derived products is indicative of the presence and/or abundance of the transcript in the sample. Thus, suitable samples include, but are not limited to, transcripts of a gene or a polynucleotide, cDNA reverse-transcribed from the transcript, cRNA transcribed from the cDNA, DNA amplified from the genes, and RNA transcribed from amplified DNA. As used herein, the category of "transcripts" includes but is not limited to pre-mRNA nascent transcripts, transcript processing intermediates, and mature mRNAs and degradation products thereof.

It is not necessary to monitor all types of transcripts to practice the invention. For example, the expression profiling methods of the invention can be conducted by detecting only one type of transcript, such as mature mRNA levels only.

In one aspect of the invention, a chromosomal DNA or cDNA library (comprising, for example, fluorescently labeled cDNA synthesized from total cell mRNA) is prepared for use in hybridization methods according to recognized methods in the art. See Sambrook et al., supra.

In another aspect of the invention, mRNA is amplified using, e.g., the MessageAmp kit (Ambion). In a further aspect, the mRNA is labeled with a detectable label. For example, mRNA can be labeled with a fluorescent chromophore, such as CyDye (Amersham Biosciences).

In some applications, it may be desirable to inhibit or destroy RNase that often is present in homogenates or lysates, before use in hybridization techniques. Methods of inhibiting or destroying nucleases are well known. In one embodiment of the invention, cells or tissues are homogenized in the presence of Chaotropic agents to inhibit nuclease. In another embodiment, RNase is inhibited or destroyed by heat treatment, followed by proteinase treatment.

Protein samples can be obtained by any means known in the art. Protein samples useful in the methods of the invention include crude cell lysates and crude tissue homogenates.

Alternatively, protein samples can be purified. Various methods of protein purification well known in the art can be found in Marshak et al., STRATEGIES FOR PROTEIN PURIFICATION AND CHARACTERIZATION: A LABORATORY COURSE MANUAL (Cold Spring Harbor Laboratory Press 1996).

2. Detecting Level of Polynucleotide Expression

For methods of the invention that comprise detecting a level of polynucleotide expression, any method for observing polynucleotide expression can be used, without limitation. Such methods include traditional nucleic acid hybridization techniques, polymerase chain reaction (PCR) based methods, and protein determination. The invention includes detection methods that use solid support-based assay formats as well as those that use solution-based assay formats.

Absolute measurements of the expression levels need not be made, although they can be made. The invention includes methods comprising comparisons of differences in expression levels between samples. Comparison of expression levels can be done visually or manually, or can be automated and done by a machine, using for example optical detection means. Subrahmanyam et al., *Blood*. 97: 2457 (2001); Prashar et al., *Methods Enzymol*. 303: 258 (1999). Hardware and software for analyzing differential expression of genes are available, and can be used in practicing the present invention. See, e.g., GenStat Software and GeneExpress® GX Explorer™ Training Manual, supra; Baxevanis & Francis-Ouellette, supra.

In accordance with one embodiment of the invention, nucleic acid hybridization techniques are used to observe polynucleotide expression. Exemplary hybridization techniques include Northern blotting, Southern blotting, solution hybridization, and S1 nuclease protection assays.

Nucleic acid hybridization typically involves contacting an oligonucleotide probe and a sample comprising nucleic acids under conditions where the probe can form stable hybrid duplexes with its complementary nucleic acid through complementary base pairing. For example, see PCT application WO 99/32660; Berger & Kimmel, *Methods Enzymol*. 152: 1 (1987). The nucleic acids that do not form hybrid duplexes are then washed away leaving the hybridized nucleic acids to be detected, typically through detection of an attached detectable label. The detectable label can be present on the probe, or on the nucleic acid sample. In one embodiment, the nucleic acids of the sample are detectably labeled polynucleotides representing the mRNA transcripts present in a plant tissue (e.g., a cDNA library). Detectable labels are commonly radioactive or fluorescent labels, but any label capable of detection can be used. Labels can be incorporated by several approached described, for instance, in WO 99/32660, supra. In one aspect RNA can be amplified using the MessageAmp kit (Ambion) with the addition of aminoallyl-UTP as well as free UTP. The aminoallyl groups incorporated into the amplified RNA can be reacted with a fluorescent chromophore, such as CyDye (Amersham Biosciences)

Duplexes of nucleic acids are destabilized by increasing the temperature or decreasing the salt concentration of the buffer containing the nucleic acids. Under low stringency conditions (e.g., low temperature and/or high salt) hybrid duplexes (e.g., DNA:DNA, RNA:RNA or RNA:DNA) will form even where the annealed sequences are not perfectly complementary. Thus, specificity of hybridization is reduced at lower stringency. Conversely, at higher stringency (e.g., higher temperature and/or lower salt and/or in the presence of destabilizing reagents) hybridization tolerates fewer mismatches.

Typically, stringent conditions for short probes (e.g., 10 to 50 nucleotide bases) will be those in which the salt concentration is at least about 0.01 to 1.0 M at pH 7.0 to 8.3 and the temperature is at least about 30° C. Stringent conditions can also be achieved with the addition of destabilizing agents such as formamide.

Under some circumstances, it can be desirable to perform hybridization at conditions of low stringency, e.g., 6×SSPE-T (0.9 M NaCl, 60 mM $NaH_2PO_4$, pH 7.6, 6 mM EDTA, 0.005% Triton) at 37° C., to ensure hybridization. Subsequent washes can then be performed at higher stringency (e.g., 1×SSPE-T at 37° C.) to eliminate mismatched hybrid duplexes. Successive washes can be performed at increasingly higher stringency (e.g., down to as low as 0.25×SSPE-T at 37° C. to 50° C.) until a desired level of hybridization specificity is obtained.

In general, standard conditions for hybridization are a compromise between stringency (hybridization specificity) and signal intensity. Thus, in one embodiment of the invention, the hybridized nucleic acids are washed at successively higher stringency conditions and read between each wash. Analysis of the data sets produced in this manner will reveal a wash stringency above which the hybridization pattern is not appreciably altered and which provides adequate signal for the particular oligonucleotide probes of interest. For example, the final wash may be selected as that of the highest stringency that produces consistent results and that provides a signal intensity greater than approximately 10% of the background intensity.

a. Oligonucleotide Probes

Oligonucleotide probes useful in nucleic acid hybridization techniques employed in the present invention are capable of binding to a nucleic acid of complementary sequence through one or more types of chemical bonds, usually through complementary base pairing via hydrogen bond formation. A probe can include natural bases (i.e., A, G, U, C or T) or modified bases (7-deazaguanosine, inosine, etc.). In addition, the nucleotide bases in the probes can be joined by a linkage other than a phosphodiester bond, so long as it does not interfere with hybridization. Thus, probes can be peptide nucleic acids in which the constituent bases are joined by peptide bonds rather than phosphodiester linkages.

Oligonucleotide probes can be prepared by any means known in the art. Probes useful in the present invention are capable of hybridizing to a nucleotide product of cell wall biosynthesis genes, such as one of SEQ ID NOs: 1-230. Probes useful in the invention can be generated using the nucleotide sequences disclosed in SEQ ID NOs: 1-230. The invention includes oligonucleotide probes having at least a 2, 10, 15, 20, 30, 35, 40, 45, 50, 55, 60, 65, 70, 75, 80, 85, or 100 nucleotide fragment of a corresponding contiguous sequence of any one of SEQ ID NOs: 1-230. The invention includes oligonucleotides of less than 2, 1, 0.5, 0.1, or 0.05 kb in length. In one embodiment, the oligonucleotide is 60 nucleotides in length.

Oligonucleotide probes can be designed by any means known in the art. See, e.g., Li and Stormo, *Bioinformatics* 17: 1067-76 (2001). Oligonucleotide probe design can be affected using software. Exemplary software includes ArrayDesigner, GeneScan, and ProbeSelect. Probes complementary to a defined nucleic acid sequence can be synthesized chemically, generated from longer nucleotides using restriction enzymes, or can be obtained using techniques such as polymerase chain reaction (PCR). PCR methods are well known and are described, for example, in Innis et al. eds., PCR PROTOCOLS: A GUIDE TO METHODS AND APPLICATIONS, Academic Press Inc. San Diego, Calif. (1990). The probes can be labeled, for example, with a radioactive, biotinylated, or fluorescent tag. Optimally, the nucleic acids in the sample are labeled and the probes are not labeled. Oligonucleotide probes generated by the above methods can be used in solution or solid support-based methods.

The invention includes oligonucleotide probes that hybridize to a product of the coding region or a 3' untranslated region (3' UTR) of a wood or cell wall polynucleotide. In one embodiment, the oligonucleotide probe hybridizes to the 3'UTR of any one of SEQ ID NOs: 1-230. The 3' UTR is generally a unique region of the gene, even among members of the same family. Therefore, the probes capable of hybridizing to a product of the 3' UTR can be useful for differentiating the expression of individual genes within a family where the coding region of the genes likely are highly homologous. This allows for the design of oligonucleotide probes to be used as members of a plurality of oligonucleotides, each capable of uniquely binding to a single gene. In another embodiment, the oligonucleotide probe comprises any one of SEQ ID NOs: 461-591. In another embodiment, the oligonucleotide probe consists of any one of SEQ ID NOs: 592-690.

b. Oligonucleotide Array Methods

One embodiment of the invention employs two or more oligonucleotide probes in combination to detect a level of expression of one or more wood or cell wall polynucleotides, such as the genes of SEQ ID NOs: 1-230. In one aspect of this embodiment, the level of expression of two or more different polynucleotide is detected. The two or more polynucleotide may be from the same or different wood or cell wall gene families discussed above. Each of the two or more oligonucleotides may hybridize to a different one of the polynucleotides.

One embodiment of the invention employs two or more oligonucleotide probes, each of which specifically hybridize to a polynucleotide derived from the transcript of a polynucleotide provided by SEQ ID NOs: 1-230. Another embodiment employs two or more oligonucleotide probes, at least one of which comprises a nucleic acid sequence of SEQ ID NOs: 461-690. Another embodiment employs two or more oligonucleotide probes, at least one of which consists of SEQ ID NOs: 461-690.

The oligonucleotide probes may comprise from about 5 to about 60, or from about 5 to about 500, nucleotide bases, such as from about 60 to about 100 nucleotide bases, including from about 15 to about 60 nucleotide bases.

One embodiment of the invention uses solid support-based oligonucleotide hybridization methods to detect gene expression. Solid support-based methods suitable for practicing the present invention are widely known and are described, for example, in PCT application WO 95/11755; Huber et al., *Anal. Biochem.* 299: 24 (2001); Meiyanto et al., *Biotechniques.* 31: 406 (2001); Relogio et al., *Nucleic Acids Res.* 30:e51 (2002). Any solid surface to which oligonucleotides can be bound, covalently or non-covalently, can be used. Such solid supports include filters, polyvinyl chloride dishes, silicon or glass based chips, etc.

One embodiment uses oligonucleotide arrays, i.e. microarrays, which can be used to simultaneously observe the expression of a number of polynucleotides, genes or gene products. Oligonucleotide arrays comprise two or more oligonucleotide probes provided on a solid support, wherein each probe occupies a unique location on the support. The location of each probe may be predetermined, such that detection of a detectable signal at a given location is indicative of hybridization to an oligonucleotide probe of a known identity. Each predetermined location can contain more than one molecule of a probe, but each molecule within the predetermined location has an identical sequence. Such predetermined locations are termed features. There can be, for example, from 2, 10, 100, 1,000, 2,000 or 5,000 or more of such features on a single solid support. In one embodiment, each oligonucleotide is located at a unique position on an array at least 2, at least 3, at least 4, at least 5, at least 6, or at least 10 times.

Oligonucleotide probe arrays for detecting gene expression can be made and used according to conventional techniques described, for example, in Lockhart et al., *Nat'l Biotech.* 14: 1675 (1996), McGall et al., *Proc. Nat'l Acad. Sci. USA* 93: 13555 (1996), and Hughes et al., *Nature Biotechnol.* 19:342 (2001). A variety of oligonucleotide array designs is suitable for the practice of this invention.

In one embodiment the one or more oligonucleotides include a plurality of oligonucleotides that each hybridizes to a different polynucleotide expressed in a particular tissue type. For example, the tissue can be developing wood.

In one embodiment, a nucleic acid sample obtained from a plant can be amplified and, optionally labeled with a detectable label. Any method of nucleic acid amplification and any detectable label suitable for such purpose can be used. For example, amplification reactions can be performed using, e.g. Ambion's MessageAmp, which creates "antisense" RNA or "aRNA" (complementary in nucleic acid sequence to the RNA extracted from the sample tissue). The RNA can optionally be labeled using CyDye fluorescent labels. During the amplification step, aaUTP is incorporated into the resulting aRNA. The CyDye fluorescent labels are coupled to the aaUTPs in a non-enzymatic reaction. Subsequent to the amplification and labeling steps, labeled amplified antisense RNAs are precipitated and washed with appropriate buffer, and then assayed for purity. For example, purity can be assay using a NanoDrop spectrophotometer. The nucleic acid sample is then contacted with an oligonucleotide array having, attached to a solid substrate (a "microarray slide"), oligonucleotide sample probes capable of hybridizing to nucleic acids of interest which may be present in the sample. The step of contacting is performed under conditions where hybridization can occur between the nucleic acids of interest and the oligonucleotide probes present on the array. The array is then washed to remove non-specifically bound nucleic acids and the signals from the labeled molecules that remain hybridized to oligonucleotide probes on the solid substrate are detected. The step of detection can be accomplished using any method appropriate to the type of label used. For example, the step of detecting can accomplished using a laser scanner and detector. For example, on can use and Axon scanner which optionally uses GenePix Pro software to analyze the position of the signal on the microarray slide.

Data from one or more microarray slides can be analyzed by any appropriate method known in the art.

Oligonucleotide probes used in the methods of the present invention, including microarray techniques, can be generated using PCR. PCR primers used in generating the probes are chosen, for example, based on the sequences of SEQ ID NOs: 1-230, to result in amplification of unique fragments of the wood or cell wall polynucleotides (i.e., fragments that hybridize to only one polynucleotide of any one of SEQ ID NOs: 1-230 under standard hybridization conditions). Computer programs are useful in the design of primers with the required specificity and optimal hybridization properties. For example, Li and Stormo, supra at 1075, discuss a method of probe selection using ProbeSelect which selects an optimum oligonucleotide probe based on the entire gene sequence as well as other gene sequences to be probed at the same time.

In one embodiment, oligonucleotide control probes also are used. Exemplary control probes can fall into at least one of three categories referred to herein as (1) normalization controls, (2) expression level controls and (3) negative controls.

In microarray methods, one or more of these control probes may be provided on the array with the inventive wood or cell wall-related oligonucleotides.

Normalization controls correct for dye biases, tissue biases, dust, slide irregularities, malformed slide spots, etc. Normalization controls are oligonucleotide or other nucleic acid probes that are complementary to labeled reference oligonucleotides or other nucleic acid sequences that are added to the nucleic acid sample to be screened. The signals obtained from the normalization controls, after hybridization, provide a control for variations in hybridization conditions, label intensity, reading efficiency and other factors that can cause the signal of a perfect hybridization to vary between arrays. In one embodiment, signals (e.g., fluorescence intensity or radioactivity) read from all other probes used in the method are divided by the signal from the control probes, thereby normalizing the measurements.

Virtually any probe can serve as a normalization control. Hybridization efficiency varies, however, with base composition and probe length. Preferred normalization probes are selected to reflect the average length of the other probes being used, but they also can be selected to cover a range of lengths. Further, the normalization control(s) can be selected to reflect the average base composition of the other probes being used. In one embodiment, only one or a few normalization probes are used, and they are selected such that they hybridize well (i.e., without forming secondary structures) and do not match any test probes. In one embodiment, the normalization controls are mammalian genes.

Expression level controls probes hybridize specifically with constitutively expressed genes present in the biological sample. Virtually any constitutively expressed gene provides a suitable target for expression level control probes. Typically, expression level control probes have sequences complementary to subsequences of constitutively expressed "housekeeping genes" including, but not limited to certain photosynthesis genes.

"Negative control" probes are not complementary to any of the test oligonucleotides (i.e., the inventive wood or cell wall-related oligonucleotides), normalization controls, or expression controls. In one embodiment, the negative control is a mammalian gene which is not complementary to any other sequence in the sample.

The terms "background" and "background signal intensity" refer to hybridization signals resulting from non-specific binding or other interactions between the labeled target nucleic acids (i.e., mRNA present in the biological sample) and components of the oligonucleotide array. Background signals also can be produced by intrinsic fluorescence of the array components themselves.

A single background signal can be calculated for the entire array, or a different background signal can be calculated for each target nucleic acid. In a one embodiment, background is calculated as the average hybridization signal intensity for the lowest 5 to 10 percent of the oligonucleotide probes being used, or, where a different background signal is calculated for each target gene, for the lowest 5 to 10 percent of the probes for each gene. Where the oligonucleotide probes corresponding to a particular cell wall biosynthesis or wood development gene hybridize well and, hence, appear to bind specifically to a target sequence, they should not be used in a background signal calculation. Alternatively, background can be calculated as the average hybridization signal intensity produced by hybridization to probes that are not complementary to any sequence found in the sample (e.g., probes directed to nucleic acids of the opposite sense or to genes not found in the sample). In microarray methods, background can be calculated as the average signal intensity produced by regions of the array that lack any oligonucleotides probes at all.

c. PCR-Based Methods

In another embodiment, PCR-based methods are used to detect polynucleotide expression. These methods include reverse-transcriptase-mediated polymerase chain reaction (RT-PCR) including real-time and endpoint quantitative reverse-transcriptase-mediated polymerase chain reaction (Q-RTPCR). These methods are well known in the art. For example, methods of quantitative PCR can be carried out using kits and methods that are commercially available from, for example, Applied BioSystems and Stratagene®. See also Kochanowski, QUANTITATIVE PCR PROTOCOLS (Humana Press, 1999); Innis et al., supra.; Vandesompele et al., Genome Biol. 3: RESEARCH0034 (2002); Stein, Cell Mol. Life Sci. 59:1235 (2002).

Polynucleotide expression can also be observed in solution using Q-RTPCR. Q-RTPCR relies on detection of a fluorescent signal produced proportionally during amplification of a PCR product. See Innis et al., supra. Like the traditional PCR method, this technique employs PCR oligonucleotide primers, typically 15-30 bases long, that hybridize to opposite strands and regions flanking the DNA region of interest. Additionally, a probe (e.g., TaqMan®, Applied Biosystems) is designed to hybridize to the target sequence between the forward and reverse primers traditionally used in the PCR technique. The probe is labeled at the 5' end with a reporter fluorophore, such as 6-carboxyfluorescein (6-FAM) and a quencher fluorophore like 6-carboxy-tetramethyl-rhodamine (TAMRA). As long as the probe is intact, fluorescent energy transfer occurs which results in the absorbance of the fluorescence emission of the reporter fluorophore by the quenching fluorophore. As Taq polymerase extends the primer, however, the intrinsic 5' to 3' nuclease activity of Taq degrades the probe, releasing the reporter fluorophore. The increase in the fluorescence signal detected during the amplification cycle is proportional to the amount of product generated in each cycle.

The forward and reverse amplification primers and internal hybridization probe is designed to hybridize specifically and uniquely with one nucleotide derived from the transcript of a target gene. In one embodiment, the selection criteria for primer and probe sequences incorporates constraints regarding nucleotide content and size to accommodate TaqMan® requirements.

SYBR Green® can be used as a probe-less Q-RTPCR alternative to the Taqman®-type assay, discussed above. ABI PRISM® 7900 SEQUENCE DETECTION SYSTEM USER GUIDE APPLIED BIOSYSTEMS, chap. 1-8, App. A-F. (2002).

A device measures changes in fluorescence emission intensity during PCR amplification. The measurement is done in "real time," that is, as the amplification product accumulates in the reaction. Other methods can be used to measure changes in fluorescence resulting from probe digestion. For example, fluorescence polarization can distinguish between large and small molecules based on molecular tumbling (see U.S. Pat. No. 5,593,867).

d. Protein Detection Methods

Proteins can be observed by any means known in the art, including immunological methods, enzyme assays and protein array/proteomics techniques.

Measurement of the translational state can be performed according to several protein methods. For example, whole genome monitoring of protein—the "proteome"—can be carried out by constructing a microarray in which binding sites comprise immobilized, preferably monoclonal, antibodies specific to a plurality of proteins having an amino acid sequence of any of SEQ ID NOs: 231-460, or proteins encoded by the polynucleotides of SEQ ID NOs: 1-230 or conservative variants thereof. See Wildt et al., *Nature Biotechnol.* 18: 989 (2000). Methods for making polyclonal and monoclonal antibodies are well known, as described, for instance, in Harlow & Lane, ANTIBODIES: A LABORATORY MANUAL (Cold Spring Harbor Laboratory Press, 1988).

Alternatively, proteins can be separated by two-dimensional gel electrophoresis systems. Two-dimensional gel electrophoresis is well-known in the art and typically involves isoelectric focusing along a first dimension followed by SDS-PAGE electrophoresis along a second dimension. See, e.g., Hames et al., GEL ELECTROPHORESIS OF PROTEINS: A PRACTICAL APPROACH (IRL Press, 1990). The resulting electropherograms can be analyzed by numerous techniques, including mass spectrometric techniques, western blotting and immunoblot analysis using polyclonal and monoclonal antibodies, and internal and N-terminal micro-sequencing.

3. Correlating Gene Expression to Phenotype and Tissue Development

As discussed above, the invention provides methods and tools to correlate cell wall polynucleotide expression to plant phenotype. Polynucleotide expression may be examined in a plant having a phenotype of interest and compared to a plant that does not have the phenotype or has a different phenotype. Such a phenotype includes, but is not limited to, increased drought tolerance, herbicide resistance, reduced or increased height, reduced or increased branching, enhanced cold and frost tolerance, improved vigor, enhanced color, enhanced health and nutritional characteristics, improved storage, enhanced yield, enhanced salt tolerance, enhanced resistance of the wood to decay, enhanced resistance to fungal diseases, altered attractiveness to insect pests, enhanced heavy metal tolerance, increased disease tolerance, increased insect tolerance, increased water-stress tolerance, enhanced sweetness, improved texture, decreased phosphate content, increased germination, increased micronutrient uptake, improved starch composition, improved flower longevity, production of novel resins, and production of novel proteins or peptides.

In another embodiment, the phenotype includes one or more of the following traits: propensity to form reaction wood, a reduced period of juvenility, an increased period of juvenility, self-abscising branches, accelerated reproductive development or delayed reproductive development.

In a further embodiment, the phenotype that is differs in the plants compares includes one or more of the following: lignin quality, lignin structure, wood composition, wood appearance, wood density, wood strength, wood stiffness, cellulose polymerization, fiber dimensions, lumen size, other plant components, plant cell division, plant cell development, number of cells per unit area, cell size, cell shape, cell wall composition, rate of wood formation, aesthetic appearance of wood, formation of stem defects, average microfibril angle, width of the S2 cell wall layer, rate of growth, rate of root formation ratio of root to branch vegetative development, leaf area index, and leaf shape.

Phenotype can be assessed by any suitable means as discussed above.

In a further embodiment, polynucleotide expression can be correlated to a given point in the cell cycle, a given point in plant development, and in a given tissue sample. Plant tissue can be examined at different stages of the cell cycle, from plant tissue at different developmental stages, from plant tissue at various times of the year (e.g. spring versus summer), from plant tissues subject to different environmental conditions (e.g. variations in light and temperature) and/or from different types of plant tissue and cells. In accordance with one embodiment, plant tissue is obtained during various stages of maturity and during different seasons of the year. For example, plant tissue can be collected from stem dividing cells, differentiating xylem, early developing wood cells, differentiated spring wood cells, differentiated summer wood cells.

It will be apparent to those skilled in the art that various modifications and variations can be made in the methods and compositions of the present invention without departing from the spirit or scope of the invention. Thus, it is intended that the present invention cover the modifications and variations of this invention provided they come within the scope of the appended claims and their equivalents.

The following examples are given to illustrate the present invention. It should be understood, however, that the invention is not to be limited to the specific conditions or details described in these examples. Throughout the specification, any and all references to a publicly available document, including a U.S. patent, are specifically incorporated by reference in their entirety.

EXAMPLE 1

Isolation and Characterization of cDNA Clones from *Eucalyptus grandis*

*Eucalyptus grandis* cDNA expression libraries were prepared from mature shoot buds, early wood phloem, floral tissue, leaf tissue (two independent libraries), feeder roots, structural roots, xylem or early wood xylem and were constructed and screened as follows.

Total RNA was extracted from the plant tissue using the protocol of Chang et al. (*Plant Molecular Biology Reporter* 11:113-116 (1993). mRNA was isolated from the total RNA preparation using either a Poly(A) Quik mRNA Isolation Kit (Stratagene, La Jolla, Calif.) or Dynal Beads Oligo $(dT)_{25}$ (Dynal, Skogen, Norway). A cDNA expression library was constructed from the purified mRNA by reverse transcriptase synthesis followed by insertion of the resulting cDNA clones in Lambda ZAP using a ZAP Express cDNA Synthesis Kit (Stratagene), according to the manufacturer's protocol. The resulting cDNAs were packaged using a Gigapack II Packaging Extract (Stratagene) using an aliquot (1-5 αl) from the 5 μl ligation reaction dependent upon the library. Mass excision of the library was done using XL1-Blue MRF' cells and XLOLR cells (Stratagene) with ExAssist helper phage (Stratagene). The excised phagemids were diluted with NZY broth (Gibco BRL, Gaithersburg, Md.) and plated out onto LB-kanamycin agar plates containing X-gal and isopropylthio-beta-galactoside (IPTG).

Of the colonies plated and selected for DNA miniprep, 99% contained an insert suitable for sequencing. Positive colonies were cultured in NZY broth with kanamycin and cDNA was purified by means of alkaline lysis and polyethylene glycol (PEG) precipitation. Agarose gel at 1% was used to screen sequencing templates for chromosomal contamination. Dye primer sequences were prepared using a Turbo Catalyst 800 machine (Perkin Elmer/Applied Biosystems Division, Foster City, Calif.) according to the manufacturer's protocol.

DNA sequence for positive clones was obtained using a Perkin Elmer/Applied Biosystems Division Prism 377 sequencer. cDNA clones were sequenced first from the 5' end and, in some cases, also from the 3' end. For some clones, internal sequence was obtained using either Exonuclease III deletion analysis, yielding a library of differentially sized subclones in pBK-CMV, or by direct sequencing using gene-specific primers designed to identified regions of the gene of interest.

The determined cDNA sequences were compared with known sequences in the EMBL database using the computer algorithms FASTA and/or BLASTN. Multiple alignments of redundant sequences were used to build reliable consensus sequences. The determined cDNA sequences are provided in SEQ ID NOS: 1-230. Based on similarity to known sequences from other plant species, the isolated polynucleotide sequences were identified as encoding wood and cell wall proteins, as detailed in Tables 1 and 2. The predicted polypeptide sequences corresponding to the polynucleotide sequences of SEQ ID NOS: 132-230 are provided in SEQ ID NOS: 362-460.

EXAMPLE 2

Isolation and Characterization of cDNA Clones from *Pinus radiata*

*Pinus radiata* cDNA expression libraries (prepared from either shoot bud tissue, suspension cultured cells, early wood phloem (two independent libraries), fascicle meristem tissue, male strobilus, root (unknown lineage), feeder roots, structural roots, female strobilus, cone primordia, female receptive cones and xylem (two independent libraries) were constructed and screened as described above in Example 1.

DNA sequence for positive clones was obtained using forward and reverse primers on a Perkin Elmer/Applied Biosystems Division Prism 377 sequencer and the determined sequences were compared to known sequences in the database as described above.

Based on similarity to known sequences from other plant species, the isolated polynucleotide sequences were identified as encoding wood and cell wall proteins, as displayed above in Table 1. The predicted polypeptide sequences corresponding to the polynucleotide sequences of SEQ ID NOS: 1-131 are provided in SEQ ID NOS: 231-361.

EXAMPLE 3

5' RACE Isolation

To identify additional sequence 5' or 3' of a partial cDNA sequence in a cDNA library, 5' and 3' rapid amplification of cDNA ends (RACE) was performed. Using the SMART RACE cDNA amplification kit (Clontech Laboratories, Palo Alto, Calif.). Generally, the method entailed first isolating poly(A) mRNA, performing first and second strand cDNA synthesis to generate double stranded cDNA, blunting cDNA ends, and then ligating of the SMART RACE. Adaptor to the cDNA to form a library of adaptor-ligated ds cDNA. Gene-specific primers were designed to be used along with adaptor specific primers for both 5' and 3' RACE reactions. Using 5' and 3' RACE reactions, 5' and 3' RACE fragments were obtained, sequenced, and cloned. The process may be repeated until 5' and 3' ends of the full-length gene were identified. A full-length cDNA may generated by PCR using primers specific to 5' and 3' ends of the gene by end-to-end PCR.

For example, to amplify the missing 5' region of a gene from first-strand cDNA, a primer was designed 5'→3' from the opposite strand of the template sequence, and from the region between ~100-200 bp of the template sequence. A successful amplification should give an overlap of ~100 bp of DNA sequence between the 5' end of the template and PCR product.

RNA was extracted from four pine tissues, namely seedling, xylem, phloem and structural root using the Concert Reagent Protocol (Invitrogen, Carlsbad, Calif.) and standard isolation and extraction procedures. The resulting RNA was then treated with DNase, using 10 U/ul DNase I (Roche Diagnostics, Basel, Switzerland). For 100 μg of RNA, 9 μl 10× DNase buffer (Invitrogen, Carlsbad, Calif.), 10 μl of Roche DNase I and 90 μl of Rnase-free water was used. The RNA was then incubated at room temperature for 15 minutes and 1/10 volume 25 mM EDTA is added. A RNeasy mini kit (Qiagen, Venlo, The Netherlands) was used for RNA clean up according to manufacturer's protocol.

To synthesize cDNA, the extracted RNA from xylem, phloem, seedling and root was used and the SMART RACE cDNA amplification kit (Clontech Laboratories Inc, Palo Alto, Calif.) was followed according to manufacturer's protocol. For the RACE PCR, the cDNA from the four tissue types was combined. The master mix for PCR was created by combining equal volumes of cDNA from xylem, phloem, root and seedling tissues. PCR reactions were performed in 96 well PCR plates, with 1 μl of primer from primer dilution plate (10 mM) to corresponding well positions. 49 μl of master mix is aliquoted into the PCR plate with primers. Thermal cycling commenced on a GeneAmp 9700 (Applied Biosystems, Foster City, Calif.) at the following parameters:

94° C. (5 sec),
72° C. (3 min), 5 cycles;
94° C. (5 sec),
70° C. (10 sec),
72° C. (3 min), 5 cycles;
94° C. (5 sec),
68° C. (10 sec),
72° C. (3 min), 25 cycles.

cDNA was separated on an agarose gel following standard procedures. Gel fragments were excised and eluted from the gel by using the Qiagen 96-well Gel Elution kit, following the manufacturer's instructions.

PCR products were ligated into pGEMTeasy (Promega, Madison, Wis.) in a 96 well plate overnight according to the following specifications: 60-80 ng of DNA, 5 μl 2× rapid ligation buffer, 0.5 μl pGEMT easy vector, 0.1 μl DNA ligase, filled to 10 μl with water, and incubated overnight.

Each clone was transformed into *E. coli* following standard procedures and DNA was extracted from 12 clones picked by following standard protocols. DNA extraction and the DNA quality was verified on an 1% agarose gel. The presence of the correct size insert in each of the clones was determined by restriction digests, using the restriction endonuclease EcoRI, and gel electrophoresis, following standard laboratory procedures.

EXAMPLE 4

Curation of an EST Sequence

During the production of cDNA libraries, the original transcripts or their DNA counterparts may have features that prevent them from coding for functional proteins. There may be insertions, deletions, base substitutions, or unspliced or improperly spliced introns. If such features exist, it is often possible to identify them so that they can be changed. Similar curation was performed on any sequence that has homology to sequences in the public databases.

The following is a general example of how a sequence was curated. After determination of the DNA sequence, BLAST analysis showed that it is related to an *Arabidopsis* gene on the publicly available *Arabidopsis* genome sequence. However, instead of coding for an approximately 240 amino acid polypeptide, the sequence being curated was predicted to code for a product of only 157 amino acid residues, suggesting an error in the DNA sequence. To identify where the genuine coding region might be, the DNA sequence to the end of each EST was translated in each of the three reading frames and the predicted sequences were aligned with the *Arabidopsis* gene's amino acid sequence. It was found that the DNA segment in one portion of the EST coded for a sequence with similarity to the carboxyl terminus of the *Arabidopsis* gene. Therefore, it appears that an unspliced intron was present in the EST.

Unspliced introns are a relatively minor issue with regard to use of a cloned sequence for overexpression of the gene of interest. The RNA resulting from transcription of the cDNA can be expected to undergo normal processing to remove the intron. Antisense and RNAi constructs are also expected to function to suppress the gene of interest. On other occasions, it may be desirable to identify the precise limits of the intron so that it can be removed. When the sequence in question has a published sequence that is highly similar, it may be possible to find the intron by aligning the two sequences and identifying the locations where the sequence identity falls off, aided by the knowledge that introns start with the sequence GT and end with the sequence AG.

When there was some doubt about the site of the intron because highly similar sequences were not available, the intron location was verified experimentally. For example, DNA oligomers were synthesized flanking the region where the suspected intron was located. RNA from the source species, either *Pinus* or *Eucalyptus*, was isolated and used as a template to make cDNA using reverse transcriptase. The selected primers were then used in a PCR reaction to amplify the correctly spliced DNA segment (predicted size of approximately 350 bp smaller than the corresponding segment of the original consensus) from the population of cDNAs. The amplified segment was then subjected to sequence analysis and compared to the consensus sequence to identify the differences.

The same procedure was used when an alternate splicing event (partial intron remaining, or partial loss of an exon) was suspected. When an EST has a small change, such as insertion or deletion of a small number of bases, computer analysis of the EST sequence could still indicate its location when a translation product of the wrong size was predicted or if there was an obvious frameshift. Verification of the true sequence was done by synthesis of primers, production of new cDNA, and PCR amplification as described above.

EXAMPLE 5

*Eucalyptus* in Silico Data

In silico gene expression was used to determine the membership of the consensi EST libraries. For each library, a consensus was determined from the number of ESTs in any tissue class divided by the total number of ESTs in a class multiplied by 1000. These values provide a normalized value that is not biased by the extent of sequencing from a library. Several libraries were sampled for a consensus value, including reproductive, bud reproductive, bud vegetative, fruit, leaf, phloem, cambium, xylem, root, stem, sap vegetative, whole plant libraries.

As shown below, a number of the inventive sequences exhibit vascular-preferred expression (more than 50% of the hits by these sequences if the databases were searched at random would be in libraries made from developing vascular tissue) and thus are likely to be involved in wood-related developmental processes. Many of the remaining wood and cell proteins exhibit vegetative-preferred expression, suggesting expression in leaf developmental processes and photosynthesis-related processes, or root-preferred expression, suggesting expression in root developmental processes and water and nutrient uptake. The data is shown in the Table 5.

TABLE 5

*Eucalyptus* In Silico Expression Profiles

| SEQ ID | ConsID | Family | 1 | 2 | 3 | 4 | 5 | 6 | 7 | 8 | 9 | 10 | 11 | 12 |
|---|---|---|---|---|---|---|---|---|---|---|---|---|---|---|
| 132 | eucalyptusSpp__002590 | Calnexin | 0.48 | 0.08 | 2.08 | 0.15 | 3.76 | 3.52 | 3.01 | | | | | 5.63 |
| 133 | eucalyptusSpp__003495 | Calnexin | 0.72 | 0.17 | 0.71 | 0.38 | | 0.22 | 1.06 | 0.31 | | 0.47 | | 4.01 |
| 134 | eucalyptusSpp__013577 | Calnexin | | | | | | | 0.04 | 0.08 | | | | 0.12 |
| 135 | eucalyptusSpp__033927 | Calnexin | | | | | | | | 0.04 | | | | |
| 136 | eucalyptusSpp__039632 | Calnexin | | | | 0.08 | | | | | | | | |
| 137 | eucalyptusSpp__006372 | Sucrose synthase | | 0.08 | 1.56 | 0.31 | 0.85 | 0.50 | 0.15 | 0.82 | | 1.19 | | 2.91 |
| 138 | eucalyptusSpp__006373 | Sucrose synthase | | | | 0.23 | 0.84 | 0.17 | 0.04 | 0.43 | | 1.19 | | 3.81 |
| 139 | eucalyptusSpp__006549 | Sucrose synthase | | 0.08 | 2.02 | 0.23 | 4.19 | 0.28 | 0.15 | 0.28 | | 1.90 | | 10.95 |
| 140 | eucalyptusSpp__019813 | Sucrose synthase | | | | | | | | 0.23 | | | | |
| 141 | eucalyptusSpp__033523 | Sucrose synthase | | | | | | | | 0.55 | | | | |
| 142 | eucalyptusSpp__001430 | Beta-glucosidase | | | | | | | | | | | | 0.74 |
| 143 | eucalyptusSpp__001556 | Beta-glucosidase | 3.38 | 0.08 | 0.60 | | 0.35 | 0.17 | 0.30 | 0.16 | | | 0.25 | 1.44 |
| 144 | eucalyptusSpp__003619 | Beta-glucosidase | | 0.17 | 0.18 | 0.15 | 0.17 | 0.17 | | 0.04 | | | | 2.29 |
| 145 | eucalyptusSpp__006486 | Beta-glucosidase | 0.48 | 0.34 | 0.19 | | | | | | | | | |
| 146 | eucalyptusSpp__006939 | Beta-glucosidase | | 0.93 | | | | 0.06 | 0.15 | 0.08 | | | | 3.13 |
| 147 | eucalyptusSpp__006955 | Beta-glucosidase | | 0.08 | 1.53 | | 3.32 | 0.17 | 0.04 | 0.28 | | | | 0.70 |
| 148 | eucalyptusSpp__007432 | Beta-glucosidase | | | 1.70 | | | 0.11 | 0.91 | 0.04 | | | | 0.33 |
| 149 | eucalyptusSpp__007745 | Beta-glucosidase | | | 0.19 | | | 0.06 | | | | | | 6.23 |
| 150 | eucalyptusSpp__007776 | Beta-glucosidase | | | 1.12 | | 0.50 | 0.11 | 0.15 | | | | | 0.68 |
| 151 | eucalyptusSpp__008889 | Beta-glucosidase | | | 1.08 | | 1.49 | 0.39 | | 0.04 | | | | 0.21 |
| 152 | eucalyptusSpp__009271 | Beta-glucosidase | | 0.51 | 2.34 | | | | | | | | | |
| 153 | eucalyptusSpp__010369 | Beta-glucosidase | 0.48 | | | | | 0.72 | | | | | | |
| 154 | eucalyptusSpp__010420 | Beta-glucosidase | | | | | | 0.06 | | 0.04 | | | | |
| 155 | eucalyptusSpp__010726 | Beta-glucosidase | | | | 0.08 | | 0.17 | 0.76 | 0.59 | | | | |
| 156 | eucalyptusSpp__011679 | Beta-glucosidase | | | | | 0.52 | 0.06 | | | | | | |

TABLE 5-continued

Eucalyptus In Silico Expression Profiles

| SEQ ID | ConsID | Family | 1 | 2 | 3 | 4 | 5 | 6 | 7 | 8 | 9 | 10 | 11 | 12 |
|---|---|---|---|---|---|---|---|---|---|---|---|---|---|---|
| 157 | eucalyptusSpp__036289 | Beta-glucosidase | | | | | | 0.17 | | 0.12 | | | | |
| 158 | eucalyptusSpp__037751 | Beta-glucosidase | | | | | | | | 0.24 | | | | |
| 159 | eucalyptusSpp__011491 | Beta-glucosidase | | | 0.49 | 0.08 | 0.17 | | | 0.24 | | | | 6.01 |
| 160 | eucalyptusSpp__016710 | Beta-glucosidase | | | | | | | | | | | | 0.33 |
| 161 | eucalyptusSpp__017035 | Beta-glucosidase | | | | | 0.50 | | | | | | | 0.36 |
| 162 | eucalyptusSpp__000843 | Beta-glucosidase | | | 1.08 | | | 0.61 | 0.15 | 0.04 | | | | 1.13 |
| 163 | eucalyptusSpp__005983 | Beta-glucosidase | | | | 0.08 | | 0.22 | 0.41 | | | | | 2.07 |
| 164 | eucalyptusSpp__008977 | Beta-glucosidase | | | 0.09 | | 0.17 | 0.39 | | | | | | 1.59 |
| 165 | eucalyptusSpp__023461 | Beta-glucosidase | | | | | 0.83 | 0.06 | 4.45 | | | | | 0.17 |
| 166 | eucalyptusSpp__009517 | Beta-glucosidase | | | 0.90 | | | 0.11 | | 0.04 | | | | 0.13 |
| 167 | eucalyptusSpp__019373 | Beta-glucosidase | | | | | | | | 0.24 | | | | |
| 168 | eucalyptusSpp__021302 | Beta-glucosidase | | 0.59 | | 0.92 | | 0.17 | 0.04 | | | | | |
| 169 | eucalyptusSpp__021738 | Beta-glucosidase | | 0.59 | | 0.92 | | 0.17 | 0.04 | | | | | |
| 170 | eucalyptusSpp__024123 | Beta-glucosidase | | 0.59 | | 0.92 | | 0.17 | 0.04 | | | | | |
| 171 | eucalyptusSpp__033744 | Beta-glucosidase | | | | | | | | 0.12 | | | | |
| 172 | eucalyptusSpp__041352 | Beta-glucosidase | | | | | 0.52 | | | | | | | |
| 173 | eucalyptusSpp__006312 | Beta-glucosidase | | 0.08 | 2.98 | 0.23 | 0.17 | 0.50 | 0.04 | 0.04 | | | | 2.30 |
| 174 | eucalyptusSpp__006494 | Beta-glucosidase | | 0.08 | | 0.15 | | 0.17 | | | | | | |
| 175 | eucalyptusSpp__008515 | Beta-glucosidase | | | 1.04 | | | | | 0.08 | | | | 0.61 |
| 176 | eucalyptusSpp__011678 | Beta-glucosidase | | | | | 1.40 | 0.61 | | | | | | |
| 177 | eucalyptusSpp__016980 | Beta-glucosidase | | 0.68 | | 0.38 | 1.16 | | 0.04 | 0.20 | | | | |
| 178 | eucalyptusSpp__020029 | Beta-glucosidase | | | | | | | | 0.60 | | | | |
| 179 | eucalyptusSpp__021882 | Beta-glucosidase | | | | | | | | | | 0.71 | | 0.13 |
| 180 | eucalyptusSpp__000640 | Hexose pyrophosphorylase | | 0.34 | | | 1.57 | 0.73 | | 0.08 | | | | 0.26 |
| 181 | eucalyptusSpp__012471 | Hexose pyrophosphorylase | | | | | 0.70 | 0.06 | | | | | | 0.25 |
| 182 | eucalyptusSpp__028949 | Hexose pyrophosphorylase | | | | | | | | 0.22 | | | | |
| 183 | eucalyptusSpp__010858 | Mannose isomerase | | | 0.98 | | | 0.06 | | 0.08 | | | | 0.26 |
| 184 | eucalyptusSpp__001308 | Sucrose phosphate synthase | | 1.35 | | 0.08 | 0.17 | 0.61 | 0.74 | 2.01 | | | | |
| 185 | eucalyptusSpp__034568 | Sucrose phosphate synthase | | | | | | | | 0.39 | | | | |
| 186 | eucalyptusSpp__038142 | Sucrose phosphate synthase | | | | | | | | 0.52 | | | | |
| 187 | eucalyptusSpp__002364 | Xyloglucan endotransglycosylase | | | | | 0.50 | | | | | | | |
| 188 | eucalyptusSpp__003103 | Xyloglucan endotransglycosylase | | 0.76 | | 0.15 | 0.17 | | | | | | | |
| 189 | eucalyptusSpp__003487 | Xyloglucan endotransglycosylase | | | | | | | | 0.28 | | | | |
| 190 | eucalyptusSpp__003488 | Xyloglucan endotransglycosylase | 0.24 | | | 0.31 | | | | 0.43 | | | | |
| 191 | eucalyptusSpp__003492 | Xyloglucan endotransglycosylase | 0.48 | | | | | | 0.11 | 0.20 | | | | 0.68 |
| 192 | eucalyptusSpp__003494 | Xyloglucan endotransglycosylase | | | | | | | | 0.04 | | | | 0.50 |
| 193 | eucalyptusSpp__004062 | Xyloglucan endotransglycosylase | | | 0.27 | | | 0.11 | | 0.04 | | | | 1.35 |
| 194 | eucalyptusSpp__004063 | Xyloglucan endotransglycosylase | | | | 0.08 | | | 0.37 | | | | | 0.74 |
| 195 | eucalyptusSpp__005148 | Xyloglucan endotransglycosylase | | | 0.54 | | | | | | | | | 0.37 |
| 196 | eucalyptusSpp__007619 | Xyloglucan endotransglycosylase | | | 2.46 | | | | | | | | | 1.00 |
| 197 | eucalyptusSpp__010673 | Xyloglucan endotransglycosylase | | | | | 0.17 | 0.06 | 1.06 | 0.04 | | | | |
| 198 | eucalyptusSpp__010807 | Xyloglucan endotransglycosylase | | | | | 0.17 | 0.44 | | 0.28 | | | | 3.62 |
| 199 | eucalyptusSpp__011549 | Xyloglucan endotransglycosylase | | | | | | 0.06 | | | | | | 0.23 |
| 200 | eucalyptusSpp__012168 | Xyloglucan endotransglycosylase | | | | | | 0.77 | | 0.04 | | | | 0.49 |
| 201 | eucalyptusSpp__012541 | Xyloglucan endotransglycosylase | | | | | 1.05 | 0.06 | | | | | | 0.38 |
| 202 | eucalyptusSpp__012905 | Xyloglucan endotransglycosylase | | | | | | | | | | | | 0.68 |
| 203 | eucalyptusSpp__017386 | Xyloglucan endotransglycosylase | | | 0.16 | 1.15 | | | | 0.24 | | | | 6.20 |
| 204 | eucalyptusSpp__022385 | Xyloglucan endotransglycosylase | | | | | | 0.06 | | | | | | 5.11 |
| 205 | eucalyptusSpp__033851 | Xyloglucan endotransglycosylase | | | | | | | | 0.35 | | | | |
| 206 | eucalyptusSpp__034061 | Xyloglucan endotransglycosylase | | | | | | | 0.30 | 0.20 | | | | |
| 207 | eucalyptusSpp__036012 | Xyloglucan endotransglycosylase | | | | | | | | 0.16 | | | | |
| 208 | eucalyptusSpp__002298 | Dirigent | | | | | | 0.06 | | | | | | 6.38 |
| 209 | eucalyptusSpp__002439 | Dirigent | | | | 0.54 | | 0.11 | | | | | | 3.54 |
| 210 | eucalyptusSpp__008836 | Dirigent | | | 0.09 | | 0.17 | 2.28 | | | | | | 0.84 |
| 211 | eucalyptusSpp__009914 | Dirigent | | | 0.18 | | | 0.39 | | | | | | 0.45 |

TABLE 5-continued

Eucalyptus In Silico Expression Profiles

| SEQ ID | ConsID | Family | 1 | 2 | 3 | 4 | 5 | 6 | 7 | 8 | 9 | 10 | 11 | 12 |
|---|---|---|---|---|---|---|---|---|---|---|---|---|---|---|
| 212 | eucalyptusSpp_009915 | Dirigent | | | 0.16 | | | 0.50 | | 0.20 | | | | 1.23 |
| 213 | eucalyptusSpp_010326 | Dirigent | | | | | | 0.50 | | | | | | |
| 214 | eucalyptusSpp_017008 | Dirigent | | | | 0.46 | 0.83 | | | | | | | |
| 215 | eucalyptusSpp_017185 | Dirigent | | | | 0.77 | 0.33 | | | 0.30 | | | | |
| 216 | eucalyptusSpp_019645 | Dirigent | | | | | | | | 0.43 | | | | 0.28 |
| 217 | eucalyptusSpp_002197 | Expansin | | | | | | 0.44 | | 0.04 | | | | 0.78 |
| 218 | eucalyptusSpp_002399 | Expansin | | | 1.49 | | | 0.61 | 0.15 | | | | | 3.60 |
| 219 | eucalyptusSpp_002532 | Expansin | | 0.08 | 1.04 | | 0.52 | 2.44 | 0.91 | 0.12 | | | | 3.53 |
| 220 | eucalyptusSpp_006932 | Expansin | | 0.08 | | | 0.17 | | | 0.12 | | | | |
| 221 | eucalyptusSpp_013492 | Expansin | | | | | | | 0.56 | | | | | |
| 222 | eucalyptusSpp_014985 | Expansin | | | | 0.62 | 0.17 | | 0.37 | | | | | 0.13 |
| 223 | eucalyptusSpp_014986 | Expansin | | | | | | | 0.07 | | | | | |
| 224 | eucalyptusSpp_015104 | Expansin | | | | | 0.17 | | 0.04 | | | | | |
| 225 | eucalyptusSpp_018610 | Expansin | | | | | | | | 0.36 | | | | |
| 226 | eucalyptusSpp_020260 | Expansin | | | | 0.08 | | | | 0.44 | | | | |
| 227 | eucalyptusSpp_028458 | Expansin | | | | | | 0.55 | | | | | | |
| 228 | eucalyptusSpp_031108 | Expansin | 1.69 | 0.08 | | | | | | 0.08 | | | | |
| 229 | eucalyptusSpp_010481 | Yieldin | | | | | 2.62 | | | 0.08 | | | | 0.12 |
| 230 | eucalyptusSpp_019062 | Yieldin | | | | 0.46 | | | | 0.43 | | | | |

In the Table, the following numbers 1-12 represent the following tissues: 1 is bud reproductive; 2 is bud vegetative; 3 is cambium; 4 is fruit; 5 is leaf; 6 is phloem; 7 is reproductive; 8 is root; 9 is sap vegetative; 10 is stem; 11 is whole; and 12 is xylem.

EXAMPLE 6

Pine In Silico Data

In silico gene expression was used to determine the membership of the consensi EST libraries. For each library, a consensus was determined from the number of ESTs in any tissue class divided by the total number of ESTs in a class multiplied by 1000. These values provide a normalized value that is not biased by the extent of sequencing from a library. Several libraries were sampled for a consensus value, including reproductive, bud reproductive, bud vegetative, fruit, leaf, phloem, cambium, xylem, root, stem, sap vegetative, whole plant libraries.

As shown below, a number of the inventive sequences exhibit vascular-preferred expression (more than 50% of the hits by these sequences if the databases were searched at random would be in libraries made from developing vascular tissue) and thus are likely to be involved in wood-related developmental processes. Many of the remaining wood and cell wall proteins exhibit vegetative-preferred expression, suggesting expression in leaf developmental processes and photosynthesis-related processes, or root-preferred expression, suggesting expression in root developmental processes and water and nutrient uptake. The data is shown in the Table 6.

TABLE 6

Pine In Silico Expression Profiles

| DNA Seq ID | Consensus ID Pinus Radiata | Family | 1 | 2 | 3 | 4 | 5 | 6 | 7 | 8 | 9 | 10 | 11 | 12 |
|---|---|---|---|---|---|---|---|---|---|---|---|---|---|---|
| 1 | 000420 | Calnexin | 0.16 | 0.42 | 0.22 | 1.16 | 0.27 | 2.20 | 0.96 | 0.93 | 0.60 | 0.90 | 7.03 | 6.88 |
| 2 | 009128 | Calnexin | | | 0.22 | 1.38 | 0.16 | 0.13 | | 0.15 | 0.22 | | 1.52 | 0.95 |
| 3 | 000082 | Beta-glucosidase | | 0.14 | 0.33 | 0.24 | | 0.56 | 0.34 | 0.07 | 0.36 | 0.18 | 1.23 | 0.93 |
| 4 | 000808 | Beta-glucosidase | 0.31 | | 0.11 | 0.59 | 0.16 | 0.53 | 0.97 | 0.55 | 0.76 | | 2.15 | 2.66 |
| 5 | 002641 | Beta-glucosidase | | | 0.22 | 0.29 | | 0.45 | 0.15 | | | 0.36 | 0.20 | |
| 6 | 003151 | Beta-glucosidase | | | | 10.45 | | 0.34 | | | | | 0.10 | 0.85 |
| 7 | 003170 | Beta-glucosidase | | | | | | | | 0.14 | 0.07 | | 0.43 | 0.70 |
| 8 | 003171 | Beta-glucosidase | 0.16 | | | 0.46 | 0.16 | 0.17 | | 0.15 | 0.07 | 0.18 | 1.46 | 1.25 |
| 9 | 005830 | Beta-glucosidase | | 0.14 | | | | | | 0.27 | | | 0.05 | |
| 10 | 006138 | Beta-glucosidase | | | 0.33 | | | | | | | | | |
| 11 | 006141 | Beta-glucosidase | | | 0.22 | 0.05 | 0.05 | 0.96 | 0.39 | 0.14 | 0.15 | | 0.41 | 11.87 |
| 12 | 008153 | Beta-glucosidase | | | 0.33 | | | 0.46 | | | 0.18 | | 0.39 | 2.75 |
| 13 | 008677 | Beta-glucosidase | | | 0.11 | 5.03 | | 1.28 | 0.80 | | 0.22 | | 0.43 | 2.72 |
| 14 | 008688 | Beta-glucosidase | | | | | | | | | | | 0.05 | |
| 15 | 008701 | Beta-glucosidase | | | | | | 0.44 | | | | | | 0.14 |
| 16 | 010276 | Beta-glucosidase | | | | 0.63 | | 0.13 | | 0.14 | | | 0.42 | 0.32 |
| 17 | 012343 | Beta-glucosidase | | | | | | 0.28 | | | | | | |
| 18 | 013199 | Beta-glucosidase | | | | | | 0.48 | | | 0.39 | | 0.23 | 0.17 |
| 19 | 014339 | Beta-glucosidase | 0.47 | | | 0.19 | | 0.56 | | | | | | 0.15 |
| 20 | 014357 | Beta-glucosidase | 0.16 | | | 0.25 | | | | | | | 0.10 | 1.28 |
| 21 | 014389 | Beta-glucosidase | 0.16 | | | | | | 0.19 | | | | | |
| 22 | 015733 | Beta-glucosidase | | | | | | | | | 0.36 | | 4.77 | |
| 23 | 015734 | Beta-glucosidase | | | | | | | | | | | 0.10 | |
| 24 | 019348 | Beta-glucosidase | | | | | | | | | | | 0.14 | |
| 25 | 020304 | Beta-glucosidase | | | | | | | | | | | 0.35 | 0.87 |
| 26 | 020305 | Beta-glucosidase | | | | | | 0.13 | | | | | | |
| 27 | 021499 | Beta-glucosidase | | | | 0.60 | | 0.15 | 0.26 | | | | | 0.72 |

TABLE 6-continued

Pine In Silico Expression Profiles

| DNA Seq ID | Consensus ID Pinus Radiata | Family | 1 | 2 | 3 | 4 | 5 | 6 | 7 | 8 | 9 | 10 | 11 | 12 |
|---|---|---|---|---|---|---|---|---|---|---|---|---|---|---|
| 28 | 021803 | Beta-glucosidase | | | | | 0.11 | 0.27 | 1.95 | | | | | |
| 29 | 024199 | Beta-glucosidase | | | | | | | | | 0.31 | | | 0.82 |
| 30 | 024166 | Beta-glucosidase | | | | | | | | | 0.08 | | | |
| 31 | 000560 | Beta-glucosidase | | | | 0.63 | | 0.13 | | | 0.25 | 0.36 | | 2.85 |
| 32 | 008324 | Beta-glucosidase | | | 0.44 | | | 0.13 | | | | | 0.24 | 1.07 |
| 33 | 008526 | Beta-glucosidase | | | | | | | | | | | 0.15 | 0.57 |
| 34 | 013209 | Beta-glucosidase | | | | | | | | | | | 0.18 | 0.56 |
| 35 | 013210 | Beta-glucosidase | | | | 0.30 | | | 0.58 | | 0.04 | | 0.67 | 0.57 |
| 36 | 018923 | Beta-glucosidase | | | | 0.41 | | | | | | | 0.05 | |
| 37 | 022167 | Beta-glucosidase | | | | | 0.05 | 0.56 | 0.11 | | | | | 0.46 |
| 38 | 005555 | Beta-glucosidase | | | | | | | | | | | 0.55 | |
| 39 | 006798 | Beta-glucosidase | | | | | | | | | 0.14 | | 0.05 | 7.44 |
| 40 | 006799 | Beta-glucosidase | | | | 0.43 | 0.11 | 0.43 | | | 0.20 | | 0.14 | 0.88 |
| 41 | 006802 | Beta-glucosidase | | | | 0.21 | | | | 0.14 | 0.04 | | 2.72 | |
| 42 | 006803 | Beta-glucosidase | 0.16 | 0.28 | 0.11 | 0.40 | | 0.47 | 0.41 | 0.14 | 0.04 | | 0.75 | 3.68 |
| 43 | 013555 | Beta-glucosidase | | | | | | 1.25 | | | 0.65 | | | |
| 44 | 014884 | Beta-glucosidase | | | | | | | | 0.73 | | | 21.39 | |
| 45 | 001975 | Beta-glucosidase | 0.16 | | 0.11 | 0.14 | | 0.19 | 0.11 | | | | | 1.80 |
| 46 | 003684 | Beta-glucosidase | | | | | 0.05 | 0.33 | | 0.15 | | 0.18 | 0.05 | |
| 47 | 008566 | Beta-glucosidase | | | 0.22 | | | | 0.15 | | | | 2.41 | |
| 48 | 013146 | Beta-glucosidase | | | | | | | | 0.58 | 0.04 | | 2.53 | |
| 49 | 014358 | Beta-glucosidase | 0.16 | | | 0.05 | | 0.13 | 0.29 | | 0.07 | | 0.16 | 1.19 |
| 50 | 014570 | Beta-glucosidase | 0.16 | | | | | | | | | | | |
| 51 | 014985 | Beta-glucosidase | | | | | | | | | 1.45 | | 31.72 | 0.17 |
| 52 | 023047 | Beta-glucosidase | | | | | | 0.41 | | | | | | 0.46 |
| 53 | 006216 | Hexose pyrophosphorylase | 0.47 | 0.14 | | 0.43 | | 0.36 | 0.22 | 0.55 | | | 1.35 | 2.27 |
| 54 | 013260 | Hexose pyrophosphorylase | 0.16 | | | | 0.11 | 0.31 | 0.11 | 0.07 | | | 0.67 | 1.45 |
| 55 | 014596 | Hexose pyrophosphorylase | 0.16 | | | 0.65 | | | | 0.14 | | | 0.21 | 0.17 |
| 56 | 021340 | Hexose pyrophosphorylase | | | | 0.64 | | | | | | | | 1.73 |
| 57 | 022975 | Hexose pyrophosphorylase | | | | | | 0.69 | 0.15 | | 0.36 | | | 0.34 |
| 58 | 007714 | Mannose isomerase | | | 0.11 | | | 0.19 | | 0.07 | 0.07 | | 0.67 | 0.83 |
| 59 | 013469 | Sucrose phosphate synthase | | | | | | 0.06 | | | | | 0.05 | |
| 60 | 016491 | Sucrose phosphate synthase | | | | | | | | | 0.07 | | 0.23 | 0.16 |
| 61 | 001007 | Xyloglucan endotransglycosylase | | 0.28 | | 3.54 | | 0.17 | 0.29 | | 0.80 | 1.79 | 0.44 | 4.35 |
| 62 | 001008 | Xyloglucan endotransglycosylase | | | | 0.97 | | | | | 0.20 | | 0.17 | 2.09 |
| 63 | 001184 | Xyloglucan endotransglycosylase | | | | | | | | | 0.07 | | 0.47 | |
| 64 | 001186 | Xyloglucan endotransglycosylase | | 0.14 | | 0.97 | | | | | | 0.18 | 0.29 | 0.19 |
| 65 | 001187 | Xyloglucan endotransglycosylase | | | | 0.39 | | | | 0.15 | | | 1.80 | |
| 66 | 001191 | Xyloglucan endotransglycosylase | | | | 0.19 | | | | | | | | |
| 67 | 001197 | Xyloglucan endotransglycosylase | | | | | | | | | | | 0.05 | |
| 68 | 001603 | Xyloglucan endotransglycosylase | | | | 0.24 | | 0.19 | 0.11 | 0.07 | | 0.36 | 0.63 | 1.00 |
| 69 | 001604 | Xyloglucan endotransglycosylase | 0.16 | | | | | | | | | | | |
| 70 | 002148 | Xyloglucan endotransglycosylase | | | | | | | | | 0.04 | 0.54 | 0.33 | |
| 71 | 005260 | Xyloglucan endotransglycosylase | | | | | 0.05 | 0.05 | | | 0.04 | | 0.82 | 2.02 |
| 72 | 005658 | Xyloglucan endotransglycosylase | | | 0.11 | | | | | 0.07 | | | 4.05 | |
| 73 | 005659 | Xyloglucan endotransglycosylase | 0.16 | | | 0.59 | 0.44 | 0.27 | 0.15 | 0.07 | 0.26 | | 2.32 | 0.31 |
| 74 | 005715 | Xyloglucan endotransglycosylase | | | | | | | | | | | | 0.16 |
| 75 | 005718 | Xyloglucan endotransglycosylase | | | 0.11 | | | 0.15 | | | 0.04 | | | 1.72 |
| 76 | 006166 | Xyloglucan endotransglycosylase | | 0.14 | | | 0.05 | | 0.11 | 0.14 | | | | |
| 77 | 008291 | Xyloglucan endotransglycosylase | | | 0.44 | 0.39 | | | | | 0.04 | | 0.25 | |

TABLE 6-continued

Pine In Silico Expression Profiles

| DNA Seq ID | Consensus ID Pinus Radiata | Family | 1 | 2 | 3 | 4 | 5 | 6 | 7 | 8 | 9 | 10 | 11 | 12 |
|---|---|---|---|---|---|---|---|---|---|---|---|---|---|---|
| 78 | 008343 | Xyloglucan endotransglycosylase | | | 0.33 | 0.43 | | | | | | | | |
| 79 | 010682 | Xyloglucan endotransglycosylase | | | | 0.69 | | 0.11 | | | | | | 1.56 |
| 80 | 011081 | Xyloglucan endotransglycosylase | | | | 0.24 | | 39.12 | | | | | 1.28 | |
| 81 | 011726 | Xyloglucan endotransglycosylase | | | | | | 0.62 | | | 0.04 | | | |
| 82 | 013444 | Xyloglucan endotransglycosylase | | | | | 0.11 | 0.19 | 0.19 | 0.42 | 0.07 | | 1.27 | 0.51 |
| 83 | 014144 | Xyloglucan endotransglycosylase | 0.16 | | | | | | | | | | 0.19 | |
| 84 | 014539 | Xyloglucan endotransglycosylase | 0.16 | | | | | | | | | | | 0.20 |
| 85 | 015716 | Xyloglucan endotransglycosylase | | | | | 0.33 | | | | | | 0.09 | |
| 86 | 016453 | Xyloglucan endotransglycosylase | | | | | | | | | 0.22 | | 0.04 | |
| 87 | 017884 | Xyloglucan endotransglycosylase | | | | | | 0.13 | | | | | 0.19 | |
| 88 | 023707 | Xyloglucan endotransglycosylase | | | | 0.21 | | 0.14 | | | | | | |
| 89 | 023708 | Xyloglucan endotransglycosylase | | | | | | | | | | | 0.18 | |
| 90 | 027337 | Xyloglucan endotransglycosylase | | | | 0.10 | | | | | | | 0.18 | 0.15 |
| 91 | 001609 | Dirigent | | | | 0.19 | | | | | 0.08 | 0.18 | | 3.96 |
| 92 | 004488 | Dirigent | | | | | | | 0.19 | | 0.04 | | 0.19 | |
| 93 | 004489 | Dirigent | | | 0.14 | 1.04 | | 0.61 | 0.63 | | | | | 3.36 |
| 94 | 005049 | Dirigent | 0.47 | 0.28 | | | | | 0.31 | | | | 0.92 | |
| 95 | 005790 | Dirigent | 0.16 | 0.14 | | | 0.16 | | 0.15 | | | | | |
| 96 | 005791 | Dirigent | | | 0.11 | | | 0.33 | | | 0.23 | | 0.29 | 0.41 |
| 97 | 006230 | Dirigent | | | | | | | 0.11 | 0.14 | | | 1.81 | |
| 98 | 006231 | Dirigent | | | | | | | | | 0.29 | | 4.39 | |
| 99 | 009358 | Dirigent | | | 0.11 | | | 0.06 | | | | | 1.14 | |
| 100 | 011003 | Dirigent | | | | 0.43 | | | | | | | | 0.75 |
| 101 | 014809 | Dirigent | | | | | | | | | 0.29 | | 0.65 | |
| 102 | 014810 | Dirigent | | | | | | | | | | | 2.18 | |
| 103 | 018046 | Dirigent | | | | | | | | | | | 0.10 | |
| 104 | 018129 | Dirigent | | | | | | | | | | | 0.14 | 0.14 |
| 105 | 019464 | Dirigent | | | | | | 0.27 | | | | 0.07 | 0.05 | |
| 106 | 019641 | Dirigent | | | | | | | | | | | 0.32 | |
| 107 | 020854 | Dirigent | | | | | | | | | | | 0.11 | |
| 108 | 022079 | Dirigent | | | | | | 0.16 | | | 0.22 | | | |
| 109 | 026378 | Dirigent | | | | | | | | | 0.07 | | | |
| 110 | 027112 | Dirigent | | | | | | | | | | | | 1.62 |
| 111 | 000134 | Expansin | | 0.42 | | 0.43 | | 0.11 | 0.11 | 0.27 | 0.04 | | 0.19 | 0.75 |
| 112 | 003894 | Expansin | | 0.56 | | | | 0.98 | 0.31 | 0.27 | 0.32 | 0.36 | 0.41 | 3.90 |
| 113 | 005134 | Expansin | | | | | | 0.82 | | | | | | |
| 114 | 005738 | Expansin | 0.16 | 0.28 | | | 0.16 | | 0.26 | | | | 0.05 | |
| 115 | 006938 | Expansin | 0.16 | 0.14 | | 0.35 | | 0.41 | 1.04 | | 0.62 | | 1.92 | 3.63 |
| 116 | 007527 | Expansin | | 0.14 | | | | | | | 0.68 | | 0.50 | |
| 117 | 008477 | Expansin | | | | 0.05 | | | | | | | | |
| 118 | 008478 | Expansin | | | | | | | | | | | 0.24 | |
| 119 | 008479 | Expansin | | | | | | | | | | | 0.77 | |
| 120 | 008480 | Expansin | | | 0.11 | | | | | | | | 0.19 | 0.33 |
| 121 | 008481 | Expansin | | | | | | | | | | | 0.05 | |
| 122 | 009863 | Expansin | | | | | | | | | | | | 2.86 |
| 123 | 009864 | Expansin | 0.16 | | | 0.05 | | 0.14 | | | | | 0.99 | 0.75 |
| 124 | 011105 | Expansin | | | | 0.59 | | 0.13 | | | 0.04 | | | |
| 125 | 012207 | Expansin | | | | | | 0.40 | | | | | | |
| 126 | 015481 | Expansin | | | | | | | | 0.15 | 0.69 | | 2.46 | 1.13 |
| 127 | 015617 | Expansin | | | | | 0.05 | | | | | | 1.37 | |
| 128 | 015619 | Expansin | | | | | | | | | 0.29 | | 1.93 | |
| 129 | 016977 | Expansin | | | | | | | | | | | 0.39 | |
| 130 | 021768 | Expansin | | | | | | 0.11 | | | 0.07 | | | |
| 131 | 026140 | Yieldin | | | | | | | | | 0.07 | | | |

In the Table, the following numbers 1-12 represent the following tissues: 1 is bud reproductive; 2 is bud vegetative; 3 is callus; 4 is cambium; 5 is meristem vegetative; 6 is phloem; 7 is reproductive female; 8 is reproductive male; 9 is root; 10 is vascular; 11 is whole; and 12 is xylem.

EXAMPLE 7

This example illustrates how polynucleotides important for wood development in *P. radiata* was determined and how oligonucleotides which uniquely bind to those genes were designed and synthesized for use on a microarray.

Open pollinated trees of approximately 16 years of age were selected from plantation-grown sites, in the United States for loblolly pine, and in New Zealand for *radiata* pine. Trees were felled during the spring and summer seasons to compare the expression of genes associated with these different developmental stages of wood formation. Trees were felled individually and trunk sections were removed from the bottom area approximately one to two meters from the base and within one to two meters below the live crown. The section removed from the basal end of the trunk contained mature wood. The section removed from below the live crown contained juvenile wood. Samples collected during the spring season were termed earlywood or springwood, while samples collected during the summer season are considered latewood or summerwood (Larson et al., Gen. Tech. Rep. FPL-GTR-129. Madison, Wis.: U.S. Department of Agriculture, Forest Service, Forest Products Laboratory, 42 p.).

Tissues were isolated from the trunk sections such that phloem, cambium, developing xylem, and maturing xylem are removed. These tissues were collected only from the current year's growth ring. Upon tissue removal in each case, the material was immediately plunged into liquid nitrogen to preserve the nucleic acids and other components. The bark was peeled from the section and phloem tissue removed from the inner face of the bark by scraping with a razor blade. Cambium tissue was isolated from the outer face of the peeled section by gentle scraping of the surface. Developing xylem and lignifying xylem were isolated by sequentially performing more vigorous scraping of the remaining tissue. Tissues were transferred from liquid nitrogen into containers for long term storage at −70° C. until RNA extraction and subsequent analysis was performed.

EXAMPLE 8

This example illustrates a procedure for RNA extraction and purification, which was particularly useful for RNA obtained from conifer needle, xylem, cambium, and phloem.

Tissue was obtained from conifer needle, xylem, cambium or phloem. The tissue was frozen in liquid nitrogen and ground. The total RNA was extracted using Concert Plant RNA reagent (Invitrogen). The resulting RNA sample was extracted into phenol:chloroform and treated with DNase. The RNA was then incubated at 65° C. for 2 minutes followed by centrifugation at 4° C. for 30 minutes. Following centrifugation, the RNA was extracted into phenol at least 10 times to remove contaminants.

The RNA was further cleaned using RNeasy columns (Qiagen). The purified RNA was quantified using RiboGreen reagent (Molecular Probes) and purity assessed by gel electrophoresis.

RNA was then amplified using MessageAmp (Ambion). Aminoallyl-UTP and free UTP were added to the in vitro transcription of the purified RNA at a ratio of 4:1 aminoallyl-UTP-to-UTP. The aminoallyl-UTP was incorporated into the new RNA strand as it was transcribed. The amino-allyl group was then reacted with Cy dyes to attach the calorimetric label to the resulting amplified RNA using the Amersham procedure modified for use with RNA. Unincorporated dye was removed by ethanol precipitation. The labeled RNA was quantified spectrophotometrically (NanoDrop). The labeled RNA was fragmented by heating to 95° C. as described in Hughes et al., *Nature Biotechnol.* 19:342 (2001).

EXAMPLE 9

This Example illustrates how genes important for wood development in *P. radiata* were determined and how oligonucleotides which uniquely bind to those genes were designed and synthesized for use on a microarray.

Pine trees of the species *P. radiata* were grown under natural light conditions. Tissue samples were prepared as described in, e.g., Sterky et al., *Proc. Nat'l Acad. Sci.* 95:13330 (1998). Specifically, tissue samples were collected from woody trees having a height of 5 meters. Tissue samples of the woody trees were prepared by taking tangential sections through the cambial region of the stem. The stems were sectioned horizontally into sections ranging from juvenile (top) to mature (bottom). The stem sections separated by stage of development were further separated into 5 layers by peeling into sections of phloem, differentiating phloem, cambium, differentiating xylem, developing xylem, and mature xylem. Tissue samples, including leaves, buds, shoots, and roots were also prepared from seedlings of the species *P. radiata*.

RNA was isolated and ESTs generated as described in Example 1 or Sterky et al., supra. The nucleic acid sequences of ESTs derived from samples containing developing wood were compared with nucleic acid sequences of genes known to be involved in polysaccharide synthesis. ESTs from samples that did not contain developing wood were also compared with sequences of genes known to be involved in the plant cell cycle. An in silico hybridization analysis was performed using BLAST (NCBI) as follows.

EXAMPLE 10

Sequences that showed hybridization in silico to ESTs made from samples containing developing wood, but that did not hybridize to ESTs from samples not containing developing wood were selected for further examination.

cDNA clones containing sequences that hybridized to the genes showing wood-preferred expression were selected from cDNA libraries using techniques well known in the art of molecular biology. Using the sequence information, oligonucleotides were designed such that each oligonucleotide is specific for only one cDNA sequence in the library. The oligonucleotide sequences are provided in Table 5. 60-mer oligonucleotide probes were designed using the method of Li and Stormo, supra or using software such as ArrayDesigner, GeneScan, and ProbeSelect.

The oligonucleotides were then synthesized in situ as described in Hughes et al., *Nature Biotechnol.* 19:324 (2002) or as described in Kane et al., *Nucleic Acids Res.* 28:4552 (2000) and affixed to an activated glass slide (Sigma-Genosis, The Woodlands, Tex.) using a 5' amino linker. The position of each oligonucleotide on the slide was known.

EXAMPLE 11

This example illustrates how to detect expression of *Pinus radiata* genes of the instant application which are important in wood formation using an oligonucleotide microarray prepared as described above. This is an example of a balanced incomplete block designed experiment carried out using RNA samples prepared from mature-phase phloem (P), cambium (C), expanding xylem found in a layer below the cambium (X1) and differentiating, lignifying xylem cells found deeper in the same growth ring (X2). In this example, cell cycle gene expression was compared among the four samples, namely P, C, X1, and X2.

In the summer, plants of the species *Pinus radiata* were felled and the bark of the main stem was immediately pulled gently away to reveal the phloem and xylem. The phloem and xylem were then peeled with a scalpel into separate containers of liquid nitrogen. Needles (leaves) and buds from the trees were also harvested with a scalpel into separate containers of liquid nitrogen. RNA was subsequently isolated from the frozen tissue samples as described in Example 1. Equal microgram quantities of total RNA were purified from each sample using RNeasy Mini columns (Qiagen, Valencia, Calif.) according to the manufacturer's instructions.

Amplification reactions were carried out for each of the P, C, X1, and X2 tissue samples. Amplification reactions were performed using Ambion's MessageAmp kit, a T7-based amplification procedure, following the manufacturer's instructions, except that a labeled aaUTP was added to the reagent mix during the amplification step. aaUTP was incorporated into the resulting antisense RNA formed during this step. CyDye fluorescent labels were coupled to the aaUTPs in a non-enzymatic reaction as described in Example 8. Labeled amplified antisense RNAs were precipitated and washed, and then assayed for purity using a NanoDrop spectrophotometer. These labeled antisense RNAs, corresponding to the RNA isolated from the P, C, X1, and X2 tissue samples, constituted the sample nucleic acids, which were referred to as the P, C, X1, and X2 samples.

Normalization control samples of known nucleic acids were added to each sample in a dilution series of 500, 200, 100, 50, 25 and 10 pg/µl for quantitation of the signals. Positive controls corresponding to specific genes showing expression in all tissues of pine, such as housekeeping genes, were also added to the plant sample.

Each of four microarray slides were incubated with 125 µL of a P, C, X1 or X2 sample under a coverslip at 42° C. for 16-18 hours. The arrays were washed in 1×SSC, 0.1% SDS for 10 minutes and then in 0.1×SSC, 0.1% SDS for 10 minutes and the allowed to dry.

The array slides were scanned using an Axon laser scanner and analyzed using GenePix Pro software. Data from the microarray slides were subjected to microarray data analysis using GenStat SAS or Spotfire software. Outliers were removed and ratiometric data for each of the datasets were normalized using a global normalization which employed a cubic spline fit applied to correct for differential dye bias and spatial effects. A second transformation was performed to fit control signal ratios to a mean $\log^2=0$ (i.e. 1:1 ratio). Normalized data were then subjected to a variance analysis.

Mean signal intensity for each signal at any given position on the microarray slide was determined for each of three of P, C, X1, and X2 sample microarray slides. This mean signal/probe position was compared to the signal at the same position on sample slide which was not used for calculating the mean. For example, a mean signal at a given position was determined for P, C, and X1 and the signal at that position in the X2 microarray slide was compared to the P, C, and X1 mean signal value.

Signal data were then verified with RT-PCR to confirm gene expression in the target tissue of the genes corresponding to the unique oligonucleotides in the probe.

EXAMPLE 12

This example illustrates how RNAs of tissues from multiple pine species, in this case both *P. radiata* and loblolly pine *P. taeda* trees, were selected for analysis of the pattern of gene expression associated with wood development in the juvenile wood and mature wood forming sections of the trees, using the microarrays derived from *P. radiata* cDNA sequences described in Example 4.

Open pollinated trees of approximately 16 years of age were selected from plantation-grown sites, in the United States for loblolly pine, and in New Zealand for radiata pine. Trees were felled during the spring and summer seasons to compare the expression of genes associated with these different developmental stages of wood formation. Trees were felled individually and trunk sections were removed from the bottom area approximately one to two meters from the base and within one to two meters below the live crown. The section removed from the basal end of the trunk contains mature wood. The section removed from below the live crown contains juvenile wood. Samples collected during the spring season were termed early wood or springwood, while samples collected during the summer season were considered late wood or summerwood. Larson et al., *Gen. Tech. Rep.* FPL-GTR-129. Madison, Wis.: U.S. Department of Agriculture, Forest Service, Forest Products Laboratory, p. 42.

Tissues were isolated from the trunk sections such that phloem, cambium, developing xylem, and maturing xylem were removed. These tissues were collected only from the current year's growth ring. Upon tissue removal in each case, the material was immediately plunged into liquid nitrogen to preserve the nucleic acids and other components. The bark was peeled from the section and phloem tissue removed from the inner face of the bark by scraping with a razor blade. Cambium tissue was isolated from the outer face of the peeled section by gentle scraping of the surface. Developing xylem and lignifying xylem were isolated by sequentially performing more vigorous scraping of the remaining tissue. Tissues were transferred from liquid nitrogen into containers for long term storage at −70° C. until RNA extraction and subsequent analysis was performed.

EXAMPLE 13

This example illustrates procedures alternative to those used in the example above for RNA extraction and purification, particularly useful for RNA obtained from a variety of tissues of woody plants, and an alternative procedure for hybridization and data analysis using the arrays described in Example 7 and 9.

RNA was isolated according to the protocol of Chang et al., Plant Mol. Biol. Rep. 11:113. DNA was removed using DNase I (Invitrogen, Carlsbad, Calif.) according to the manufacturer's recommendations. The integrity of the RNA samples was determined using the Agilent 2100 Bioanalyzer (Agilent Technologies, USA).

10 µg of total RNA from each tissue was reverse transcribed into cDNA using known methods.

In the case of *Pinus radiata* phloem tissue, it can be difficult to extract sufficient amounts of total RNA for normal labelling procedures. Total RNA was extracted and treated as previously described and 100 ng of total RNA was amplified using the Ovation™ Nanosample RNA Amplification system from NuGEN™ (NuGEN, CA, USA). Similar amplification kits such as those manufactured by Ambion may alternatively be used. The amplified RNA was reverse transcribed into cDNA and labelled as described above.

Hybridization and stringency washes were performed using the protocol as described in the US patent application for "Methods and Kits for Labeling and Hybridizing cDNA for Microarray Analysis" (supra) at 42° C. The arrays (slides)

were scanned using a ScanArray 4000 Microarray Analysis System (GSI Lumonics, Ottawa, ON, Canada). Raw, non-normalized intensity values were generated using QUANTARRAY software (GSI Lumonics, Ottawa, ON, Canada).

A fully balanced, incomplete block experimental design (Kerr and Churchill, *Gen. Res.* 123:123, 2001) was used in order to design an array experiment that would allow maximum statistical inferences from analyzed data.

Gene expression data was analyzed using the SAS® Microarray Solution software package (The SAS Institute, Cary, N.C., USA). Resulting data was then visualized using JMP® (The SAS Institute, Cary, N.C., USA).

Analysis done for this experiment was an ANOVA approach with mixed model specification (Wolfinger et al., *J. Comp. Biol.* 8:625-637). Two steps of linear mixed models were applied. The first one, normalization model, was applied for global normalization at slide-level. The second one, gene model, was applied for doing rigorous statistical inference on each gene. Both models are stated in Models (1) and (2).

$$\log_2(Y_{ijkls}) = \theta_{ij} + D_k + S_l + DS_{kl} + \omega_{ijkls} \quad (1)$$

$$R_{ijkls}{}^{(g)} = \mu_{ij}{}^{(g)} + D_k{}^{(g)} + S_l{}^{(g)} + DS_{kl}{}^{(g)} + SS_{ls}{}^{(g)} + \epsilon_{ijkls}{}^{(g)} \quad (2)$$

$Y_{ijkls}$ represents the intensity of the $s^{th}$ spot in the $l^{th}$ slide with the $k^{th}$ dye applying the $j^{th}$ treatment for the $i^{th}$ cell line. $\theta_{ij}$, $D_k$, $S_l$, and $D_{Skl}$ represent the mean effect of the jth treatment in the ith cell line, the kth dye effect, the $l^{th}$ slide random effect, and the random interaction effect of the $k^{th}$ dye in the $l^{th}$ slide. $\omega_{ijkls}$ is the stochastic error term. $R_{ijkls}{}^{(g)}$ represents the residual of the $g^{th}$ gene from model (1). $\mu_{ij}{}^{(g)}$, $D_k{}^{(g)}$, $S_l{}^{(g)}$, and $DS_{kl}{}^{(g)}$ represent the similar roles as $\theta_{ij}$, $D_k$, $S_l$, and $DS_{kl}$ except they are specific for the $g^{th}$ gene. $SS_{ls}{}^{(g)}$ represent the spot by slide random effect for the $g^{th}$ gene. $\epsilon_{ijkls}{}^{(g)}$ represent the stochastic error term. All random terms are assumed to be normally distributed and mutually independent within each model.

According to the analysis described above, certain cDNAs, some of which are shown in Table 7, were found to correspond to different steady state levels of RNA which may correspond to differences in gene expression or transcript stability.

The involvement of these specific genes in wood development is inferred through the association of the up-regulation or down-regulation of genes to the particular stages of wood development. Both the spatial continuum of wood development across a section (phloem, cambium, developing xylem, maturing xylem) at a particular season and tree trunk position and the relationships of season and tree trunk position are considered when making associations of gene expression to the relevance in wood development.

EXAMPLE 14

This example demonstrates how one can correlate polysaccharide gene expression with agronomically important wood phenotypes such as density, stiffness, strength, distance between branches, and spiral grain.

Mature clonally propagated pine trees were selected from among the progeny of known parent trees for superior growth characteristics and resistance to important fungal diseases. The bark was removed from a tangential section and the trees were examined for average wood density in the fifth annual ring at breast height, stiffness and strength of the wood, and spiral grain. The trees were also characterized by their height, mean distance between major branches, crown size, and forking.

To obtain seedling families that are segregating for major genes that affect density, stiffness, strength, distance between branches, spiral grain and other characteristics that may be linked to any of the genes affecting these characteristics, trees lacking common parents were chosen for specific crosses on the criterion that they exhibit the widest variation from each other with respect to the density, stiffness, strength, distance between branches, and spiral grain criteria. Thus, pollen from a tree exhibiting high density, low mean distance between major branches, and high spiral grain was used to pollinate cones from the unrelated plus tree among the selections exhibiting the lowest density, highest mean distance between major branches, and lowest spiral grain. It is useful to note that "plus trees" were crossed such that pollen from a plus tree exhibiting high density was used to pollinate developing cones from another plus tree exhibiting high density, for example, and pollen from a tree exhibiting low mean distance between major branches was used to pollinate developing cones from another plus tree exhibiting low mean distance between major branches.

TABLE 7

*Pinus* cDNAs corresponding to different Steady State RNA.

| SEQ ID | Oligo ID | Gene_Family | Steady State RNA |
|---|---|---|---|
| 8 | Pra_003171_O_1 | 1,3-beta-D-glucanase | transcripts significantly higher in late developing xylem relative to cambium |
| 56 | Pra_021340_O_1 | Mannose-1-phosphate guanylyltransferase (GDP) | transcripts significantly higher in early developing xylem relative to cambium |
| 61 | Pra_001007_O_1 | Xyloglucan:xyloglucosyl transferase | transcripts significantly higher in early developing xylem relative to late developing xylem |
| 69 | Pra_001604_O_1 | Xyloglucan:xyloglucosyl transferase | transcripts significantly higher in cambium relative to phloem and developing xylem |
| 68 | Pra_001603_O_1 | Xyloglucan:xyloglucosyl transferase | |
| 15 | Pra_008701_O_1 | 1,3-beta-D-glucanase | transcripts significantly higher in cambium relative to developing xylem (in order of increasing magnitude of the difference) |
| 13 | Pra_008677_O_1 | 1,3-beta-D-glucanase | |
| 96 | Pra_005791_O_1 | Dirigent | |
| 74 | Pra_005715_O_2 | Xyloglucan:xyloglucosyl transferase | |
| 93 | Pra_004489_O_1 | Dirigent | |
| 17 | Pra_012343_O_2 | 1,3-beta-D-glucanase | transcripts significantly higher in phloem relative to cambium |
| 65 | Pra_001187_O_1 | Xyloglucan:xyloglucosyl transferase | transcripts significantly lower in phloem relative to cambium (in order of increasing magnitude of the difference) |
| 69 | Pra_001604_O_1 | Xyloglucan:xyloglucosyl transferase | |
| 35 | Pra_013210_O_2 | Exo-1,4-beta-xylanase | |
| 68 | Pra_001603_O_1 | Xyloglucan:xyloglucosyl transferase | |

Seeds were collected from these controlled pollinations and grown such that the parental identity was maintained for each seed and used for vegetative propagation such that each genotype was represented by multiple ramets. Vegetative propagation was accomplished using micropropagation, hedging, or fascicle cuttings. Some ramets of each genotype were stored while vegetative propagules of each genotype were grown to sufficient size for establishment of a field planting. The genotypes were arrayed in a replicated design and grown under field conditions where the daily temperature and rainfall was measured and recorded.

The trees were measured at various ages to determine the expression and segregation of density, stiffness, strength, distance between branches, spiral grain, and any other observable characteristics that may be linked to any of the genes affecting these characteristics. Samples were harvested for characterization of cellulose content, lignin content, cellulose microfibril angle, density, strength, stiffness, tracheid morphology, ring width, and the like. RNA was then collected from replicated samples of trees showing divergent stiffness and density, or other characteristics, from genotypes that were otherwise as similar as possible in growth habit, in spring and fall so that early and late wood development was assayed. These samples were examined for gene expression similarly as shown in Table 8 below.

TABLE 8

Pinus Genes Confer Wood Phenotypes

| SEQ ID | Gene Family | Consensus_ID | Expression |
|---|---|---|---|
| 61 | Xyloglucan:xyloglucosyl transferase | pinusRadiata_001007 | up in juvenile vs mature Xylem* |
| 62 | Xyloglucan:xyloglucosyl transferase | pinusRadiata_001008 | up in juvenile vs mature Xylem * |
| control | Ribonucleoside-diphosphate reductase | pinusRadiata_000218 | up in early vs late developing Xylem |
| control | Nitrite transporter | pinusRadiata_016801 | up in mature vs juvenile Cambium |

Ramets of each genotype were compared to ramets of the same genotype at different ages to establish age:age correlations for these characteristics.

EXAMPLE 15

This example demonstrates how responses to environmental conditions such as light and season alter plant phenotype and can be correlated to polysaccharide synthesis gene expression using microarrays. In particular, the changes in gene expression associated with wood density are examined.

Trees of three different clonally propagated *E. grandis* hybrid genotypes are grown on a site with a weather station that measures daily temperatures and rainfall. During the spring and subsequent summer, genetically identical ramets of the three different genotypes are first photographed with north-south orientation marks, using photography at sufficient resolution to show bark characteristics of juvenile and mature portions of the plant, and then felled. The age of the trees is determined by planting records and confirmed by a count of the annual rings. In each of these trees, mature wood is defined as the outermost rings of the tree below breast height, and juvenile wood as the innermost rings of the tree above breast height. Each tree is accordingly sectored as follows:

| NM | NORTHSIDE MATURE |
| SM | SOUTHSIDE MATURE |
| NT | NORTHSIDE TRANSITION |
| ST | SOUTHSIDE TRANSITION |
| NJ | NORTHSIDE JUVENILE |
| SJ | SOUTHSIDE JUVENILE |

Tissue is harvested from the plant trunk as well as from juvenile and mature form leaves. Samples are prepared simultaneously for phenotype analysis, including plant morphology and biochemical characteristics, and gene expression analysis. The height and diameter of the tree at the point from which each sector was taken is recorded, and a soil sample from the base of the tree is taken for chemical assay. Samples prepared for gene expression analysis are weighed and placed into liquid nitrogen for subsequent preparation of RNA samples for use in the microarray experiment. The tissues are denoted as follows:

| P | phloem |
| C | cambium |
| X1 | expanding xylem |
| X2 | differentiating and lignifying xylem |

Thin slices in tangential and radial sections from each of the sectors of the trunk are fixed as described in Ruzin, PLANT MICROTECHNIQUE AND MICROSCOPY, Oxford University Press, Inc., New York, N.Y. (1999) for anatomical examination and confirmation of wood developmental stage. Microfibril angle is examined at the different developmental stages of the wood, for example juvenile, transition and mature phases of *Eucalyptus grandis* wood. Other characteristics examined are the ratio of fibers to vessel elements and ray tissue in each sector. Additionally, the samples are examined for characteristics that change between juvenile and mature wood and between spring wood and summer wood, such as fiber morphology, lumen size, and width of the S2 (thickest) cell wall layer. Samples are further examined for measurements of density in the fifth ring and determination of modulus of elasticity using techniques well known to those skilled in the art of wood assays. See, e.g., Wang, et al., *Non-destructive Evaluations of Trees*, EXPERIMENTAL TECHNIQUES, pp. 28-30 (2000).

For biochemical analysis, 50 grams from each of the harvest samples are freeze-dried and analyzed, using biochemical assays well known to those skilled in the art of plant biochemistry for quantities of simple sugars, amino acids, lipids, other extractives, lignin, and cellulose. See, e.g., Pettersen & Schwandt, *J. Wood Chem. & Technol.* 11:495 (1991).

In the present example, the phenotypes chosen for comparison are high density wood, average density wood, and low density wood. Nucleic acid samples are prepared as described in Examples 1-2, from trees harvested in the spring and summer. Gene expression profiling by hybridization and data analysis is performed as described above.

Using similar techniques and clonally propagated individuals one can examine polysaccharide gene expression as it is related to other complex wood characteristics such as strength, stiffness and spirality.

EXAMPLE 16

This example demonstrates how a gene of the instant application can be linked to a tissue-preferred promoter and expressed in pine resulting in a plant with increased wood density.

A gene of the instant application, which is found by the methods of the previous examples to be more highly expressed during the early spring, is cloned into a DNA construct having the density-related polypeptide operably linked to a promoter is placed into an appropriate binary vector and transformed into pine using the methods described herein. Pine plants are transformed as described in herein and the transgenic pine plants are used to establish a forest planting. Increased density even in the spring wood (early wood) is observed in the transgenic pine plants relative to control pine plants which are not transformed with the density related DNA construct.

EXAMPLE 17

This example demonstrates how gene expression analysis can be used to find gene variants which are present in mature plants having a desirable phenotype. The presence or absence of such a variant can be used to predict the phenotype of a mature plant, allowing screening of the plants at the seedling stage. Although this example employs eucalyptus, the method used herein is also useful in breeding programs for pine and other tree species.

The sequence of a putative density-related gene is used to probe genomic DNA isolated from *Eucalyptus* that vary in density as described in wood phenotypes are examined. One hybrid exhibits high wood density and another hybrid exhibits its lower wood density. A molecular marker in the 3' portion of the coding region is found which distinguishes a high-density gene variant from a lower density gene variant.

This molecular marker enables tree breeders to assay non-transgenic *Eucalyptus* hybrids for likely density profiles while the trees are still at seedling stage, whereas in the absence of the marker, tree breeders must wait until the trees have grown for multiple years before density at harvest age can be reliably predicted. This enables selective outplanting of the best trees at seedling stage rather than an expensive culling operation and resultant erosion at thinning age. This molecular marker is further useful in the breeding program to determine which parents will give rise to high density outcross progeny.

Molecular markers found in the 3' portion of the coding region of the gene that do not correspond to variants seen more frequently in higher or lower wood density non-transgenic *Eucalyptus* hybrid trees are also useful. These markers are found to be useful for fingerprinting different genotypes of *Eucalyptus*, for use in identity-tracking in the breeding program and in plantations.

EXAMPLE 18

This example demonstrates the use of a vascular-preferred promoter functionally linked to one of the genes of the instant application.

A vascular-preferred promoter, such as any of those in U.S. application Ser. No. 10/703,091, filed Nov. 7, 2003, is then linked to one of the genes in the instant application and used to transform tree species. Boosted transcript levels of the candidate gene in the xylem of the transformants results in an increased xylem biomass phenotype.

In another example, a vascular-preferred promoter such as any of those disclosed in U.S. application Ser. No. 10/717,897, filed Nov. 21, 2003, or U.S. application Ser. No. 10/703,091, filed Nov. 7, 2003, both of which are incorporated by reference. For instance, a vascular-preferred promoter is linked to an RNAi construct containing sequences from one of the genes in the instant application and used to transform a tree of the genus from which the gene was isolated. Reduced transcript levels of the candidate gene in the xylem of the transformants results in an increased xylem biomass phenotype.

EXAMPLE 19

This example demonstrates the use of a vascular preferred promoter functionally linked to one of the genes of the instant application.

The plasmid pOX16 was cloned using the following steps. The plasmid pWVK223 (FIG. 225, SEQ ID NO: 691) a plasmid derived from pBI121 (Clontech laboratories, Palo Alto Calif.) that had the 35S promoter GUS sequence replaced with the 4CL promoter from *P. taeda* (U.S. Pat. No. 6,252,135) and the NOS promoter that drives the NPTII gene replaced with the UBQ10 promoter from *Arabidopsis* (Sun; C. W & Callis, J (1997) *Plant J.*, 11:101-111) was first made. A multicloning site was added at the HindIII and ClaI sites by using the synthesized complimentary oligonucletides MCSI and MCSII.

```
MCSI
AGCTCTACAATTGGCTAGCAAAGTACTTAAAGCTTCCAT

Figure 226:
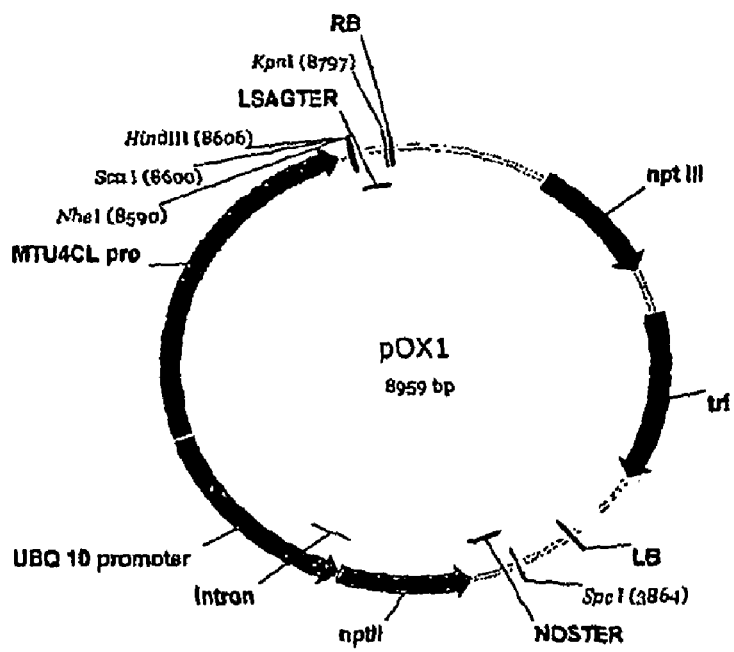
FIG. 226 shows the schematic representation of pOX1.
Figure 227:
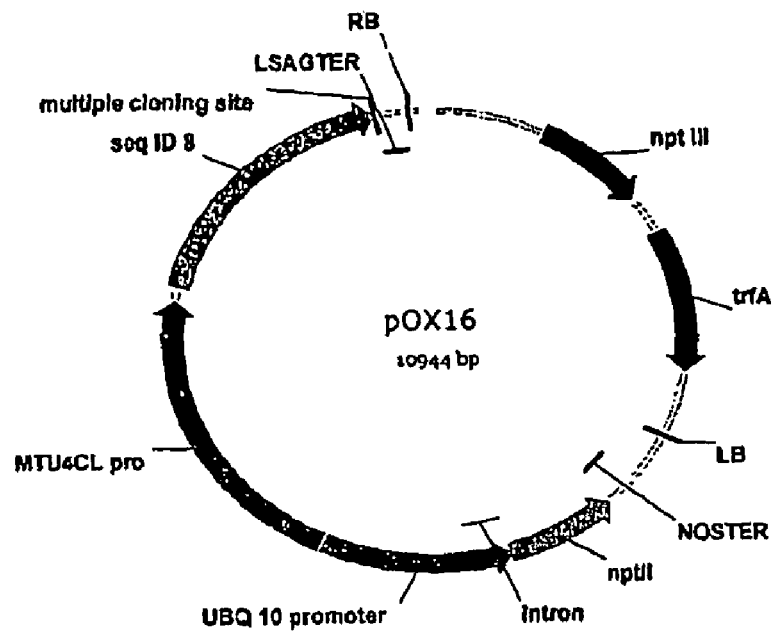
FIG. 227 shows the schematic representation of pOX16.

MCSII
GATGTTAACCGATCGTTTCATGAATTTCGAAGGTAGC
``` pWVK223 was then used as a backbone to created the intermediate plasmid pOX1 (FIG. 226 and SEQ ID NO: 692) by replacing the NOS terminator with the AGAMOUS terminator from Liquidambar styraciflua (LSAGter) (U.S. Pat. No. 6,444,877). The NheI and ScaI restriction sites in the pOX1 plasmid were then used to add the gene of SEQ ID 8, isolated from the appropriate cDNA clone from Example 2 to create the plasmid pOX16 (FIG. 227 and SEQ ID NO: 693).

Figure 228:
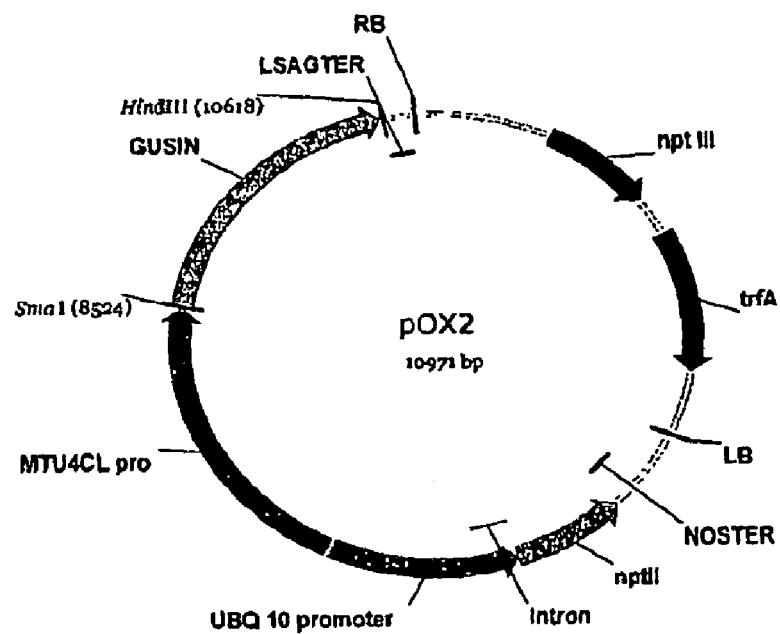
FIG. 228 shows the schematic representation of pOX2.

The control DNA construct pOX2 was engineered by using the plamid pOX1 as the backbone. The GUS INT gene (Vancanneyt et. al. *Mol. Gen. Genet.* 220:245-250, 1990) was added at the HindIII and SmaI sites of the pOX1 plasmid to create the plasmid pOX2 (FIG. 228 and SEQ ID NO: 694).

EXAMPLE 20

This example demonstrates the transformation and propagation of Cottonwood (*Populus deltoides*). The constructs pOX16 and pOX2 were made as described in the preceding example and were inoculated into *Agrobacterium* cultures by standard techniques.

*Populus deltoldes* stock plant cultures were maintained on hormone-free BTM (Chalupa, Communicationes Instituti Forestalis Checsloveniae 13:7-39, 1983, available commercially from Sigma/Aldrich) or WPM medium (Woody Plant Medium—Lloyd, G., and McCown, B., 1981. Woody plant medium. Proc. Intern. Plant Prop. Soc. 30:421, available commercially from Sigma/Aldrich) in a growth room with a 16 h photoperiod. For transformation, petioles were excised aseptically using a sharp scalpel blade from the stock plants, cut into 4-6 mm lengths and placed on DKW medium (Driver and Kuniyuki, 1984, McGranahan et al. 1987, available commercially from Sigma/Aldrich) with 1 mg/ml BAP and 1 mg/ml NAA immediately after harvest, and incubated in a dark growth chamber (28 degrees C.) for 24 hours.

*Agrobacterium* cultures containing the pOX16 construct were grown to log phase, indicated by an OD600 between 0.8-1.0 A, then pelleted and resuspended in an equal volume of *Agrobacterium* Induction Medium (AIM) (WPM salts with glucose at 5 g/l, 250 μM acetosyringone, 2 mM phosphate buffer, and 0.05 M MES, pH 5.8) The pellet was resuspended by vortexing. The bacterial cells were incubated for an hour in this medium at 28 degrees C. in an environmental chamber, shaking at 100 rpm.

After the induction period, *Populus deltoides* explants were exposed to the *Agrobacterium* mixture for 15 minutes. The explants were then lightly blotted on sterile paper towels, replaced onto the same plant medium and cultured in the dark at 18-20 degrees C. After a three-day co-cultivation period, the explants were transferred to DKW medium in which the NAA concentration was reduced to 0.1 ug/ml and to which was added 400 mg/L timentin to eradicate the *Agrobacterium*.

After 4 days on eradication medium, explants were transferred to small magenta boxes containing the same medium supplemented with timentin (400 mg/L) as well as the selection agent geneticin (50 mg/L). Explants were transferred every two weeks to fresh selection medium. Calli that grew in the presence of selection were isolated and sub-cultured to fresh selection medium every three weeks. Calli were observed for the production of adventitious shoots.

Adventitious shoots were normally observed within two months from the initiation of transformation. These shoot clusters were transferred to DKW medium to which no NAA was added, and in which the BAP concentration was reduced to 0.5 mg/ml, for shoot elongation, typically for about 14 weeks. Elongated shoots were excised and transferred to hormone-free WPM or BTM medium at pH5.8, containing 20 g/l sucrose and 5 g/l activated charcoal. See Table 9 below.

TABLE 9

Rooting medium for *Populus deltoids*.

| BTM-1 Media Components | mg/L |
|---|---|
| $NH_4NO_3$ | 412 |
| $KNO_3$ | 475 |
| $Ca(NO_3)_2 \cdot 4H_2O$ | 640 |
| $CaCl_2 \cdot 2H_2O$ | 440* |
| $MgSO_4 \cdot 7H_2O$ | 370 |
| $KH_2 \cdot PO_4$ | 170 |
| $MnSO_4 \cdot H_2O$ | 2.3 |
| $ZnSO_4 \cdot 7H_2O$ | 8.6 |
| $CuSO_4 \cdot 5H_2O$ | 0.25 |
| $CoCl_2 \cdot 6H_2O$ | 0.02 |
| KI | 0.15 |
| $H_3BO_3$ | 6.2 |
| $Na_2MoO_4 \cdot 2H_2O$ | 0.25 |
| $FeSO_4 \cdot 7H_2O$ | 27.8 |
| $Na_2EDTA \cdot 2H_2O$ | 37.3 |
| Myo-inositol | 100 |
| Nicotinic acid | 0.5 |
| Pyridoxine HCl | 0.5 |
| Thiamine HCl | 1 |
| Glycine | 2 |
| Sucrose | 20000 |
| Activated Carbon | 5000 |

After development of roots, typically four weeks, transgenic plants were propagated in the greenhouse by rooted cutting methods, or in vitro through axillary shoot induction for four weeks on DKW medium containing 11.4 uM zeatin, after which the multiplied shoots were separated and transferred to root induction medium. Rooted plants were transferred to soil for evaluation of growth in glasshouse and field conditions.

EXAMPLE 21

This example demonstrates the effect of transforming a tree with the constructs from Example 19.

*Populus deltoids* plants transformed with the plasmids pOX16 and pOX2 as described in Example 20 were grown in Ray Leach supercells C10 "Cone-tainers"™ in a greenhouse. After 5 months plants were measured for height, caliper and volume. Height measurements were taken to the nearest cm by measuring from the neck of the supercell collar to the apical meristem of each plant. Caliper of the plants were measured using a digital caliper (Mitutoyo—Aurora, Ill.) to the nearest 0.01 mm. Caiper measurements were taken at the clearest region of trunk (i.e. no branches, knots, or bulges) just above the neck of the supercell collar. Volume index was calculated using the following formula: Volume=(radius)$^2$*3.1415926*height.

pOX16 plants transformed with the gene of SEQ ID 8 when compared to the GUS control plants of pOX2 had a greater height, caliper and volume. When comparing all 65 ramets produced from all 5 translines of pOX16 to all 26 ramets produced from all 3 translines of the pOX2 control it was observed that the mean height was 126% greater than the control, the mean caliper was 134% greater than the control and the mean volume index was 227% greater than the control.

TABLE 10

Transgenic plant measurements for each plasmid

| Plasmid | Number of ramets (n) | Mean Volume index | Mean Height | Mean Caliper |
|---|---|---|---|---|
| pOX16 | 65 | 32.40 | 88.19 | 6.84 |
| pOX2 | 26 | 14.28 | 69.85 | 5.10 |

When comparing individual translines the increases in height, caliper and volume can be even higher, for example transline TDL003979 of pOX16 transformed plants showed the greatest increases in height, caliper and volume when compared to the pOX2 controls (see table 11).

TABLE 11

Transgenic plant measurements for each transline

| Plasmid | Transline | Number of ramets (n) | Mean Volume index (cm$^3$) | Mean Height (cm) | Mean Caliper (mm) |
|---|---|---|---|---|---|
| pOX16 | TDL003769 | 6 | 6.82 | 45.00 | 4.37 |
| pOX16 | TDL003978 | 15 | 35.15 | 92.97 | 6.81 |
| pOX16 | TDL003979 | 14 | 50.89 | 98.61 | 8.02 |
| pOX16 | TDL003980 | 15 | 30.82 | 90.07 | 6.54 |
| pOX16 | TDL003981 | 15 | 36.45 | 89.14 | 7.07 |
| pOX2 | TDL003824 | 11 | 15.73 | 65.91 | 5.49 |
| pOX2 | TDL003823 | 10 | 13.81 | 76.70 | 4.69 |
| pOX2 | TDL003819 | 5 | 13.38 | 64.80 | 5.07 |

Figure 229:
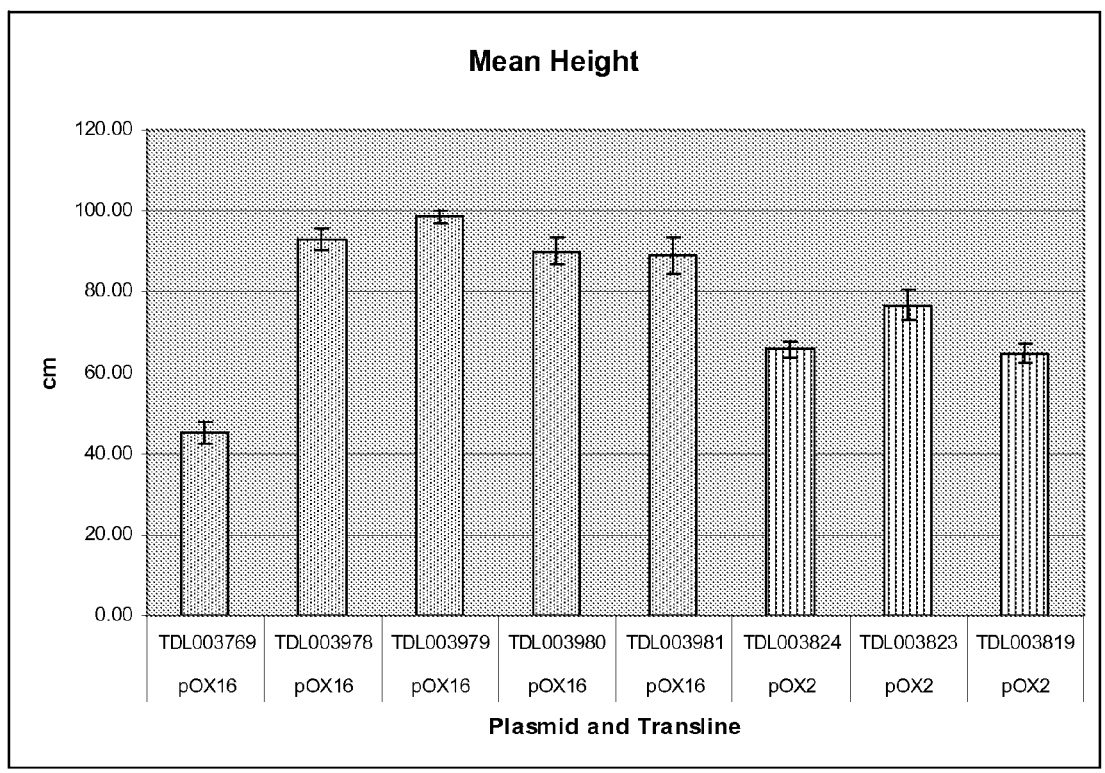
FIGS. 229-231 describe the height, caliper and volume in pOX16 and pOX2 Translines.
Figure 230:
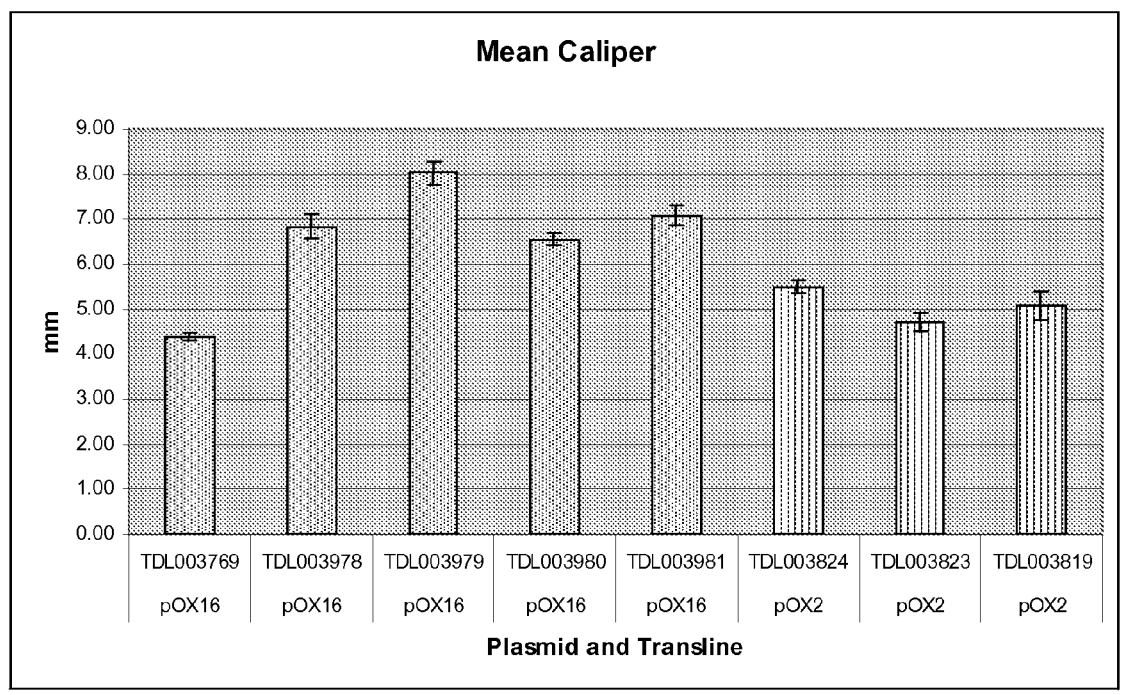
Figure 231:
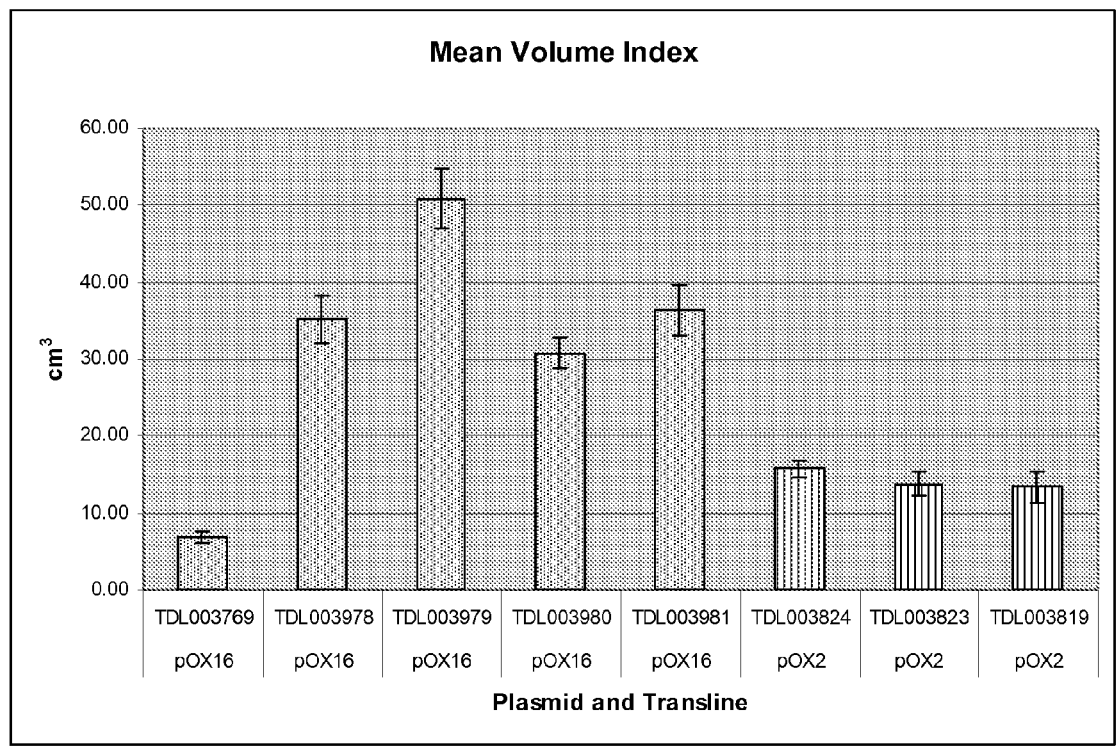

When analyzing each transline separately it was observed that 4 of the 5 pOX16 translines had significant increases in height, caliper and volume when compared to the controls. This can be easily observed in FIGS. 229-331.

SEQUENCE LISTING (696 sequences)

SEQ ID NO: 1 - DNA, 2079 bp, Pinus radiata
ccagcggaacttttatttgcattttcatcgttcaaagctgttacaagggttcgaattctaagattgaaaaccctcaaatactcgtcgagttccgcataaaagcccgcagacggtcgtctctggagatagcttaacgtacgcagagtgattggctgtgtaaaggcgtttattttcaggtggtttgcaggcattttttgtatggtctccatggatcggagatggattccattgcttttggctctgctgtgcctaatgtcaccgttaaatgccctcgtttccgcttctgaatcgactttttatgaatcttttgacgagtcgttcgaagggagatggatcgtatcccaaaaggaagattataaaggtgtatggaagtacgaaaagagtaaaggtcatgaagactatggtctccttgtgagtgaagtggccaaaaagtatgccatagtaagagaattaccagaaaccattgaccccaaggatgggtcactggtgttacagtatgaggtccgcttacaaaatgggctggagtgtggaggtgcttacttgaagtacctacggcctcaagaagctggatggaaaccagcagagtttgacaatgaatccccctactccatcatgtttggaccagataaatgcggtgctactaacaaggtacacttcatctacaagcacaagaatccaaagtctggggaatatgttgagcaccatctcaagtatcctccatctattccctctgacaagaagacacatgtttattcagccatcttgacacctgataatcaagttagaattttaattgatggcgaagagaagaaaaaggcaaatcttttgtctgcggatgattttgaacccgccctcatcccacctaagacgattcccgacccagaggataagaagccagaagactgggatgagagagcaaagatccctgatcctgatgcggaaaagcccgaggactgggatgaggatgcaccgatggaaattgaagatttggaagccgtgaaacctgaaggatggctggatgatgaaccagaggaggttgatgatcctgaagctacaaagccagatgattgggatgatgaagaagatggagaatgggaggcaccaaaggtttctaatcccaagtgcgatgaggcaccaggatgtggtgaatggactagacccatgaagagcaaccctgattacaagggcaagtggtatgctccgatgattgacaatcctaactacaagggtatctggaagccacaacaaattcccaaccccgagtactttgaactggagaagcctgatttagaaccaattgcagctattggtattgaaatctggaccatgcaagatggaattttgtttgacaacatacttatcacacatgatgagaaggttgcggaggagtacagaaagaatacatggaaggcaaaatttagcaatgaaaaagaagaggaagatgtggatagtcctttgccaggagagctctctggtttccagaagaaaatttttgacgtcctctacaagatcgcaaacatcccattcttggaagcatacaagttgaagattattgatttaatcgaacaaggtgagaagaaaccaaatttgacaattggcattttagtggccgttttggtggttctgttgacaacaatttacaagctccttttcggtggcaagaagcaacctgttcagaaggtagagttgaaaagtcagcccgagcaggatgcttctgcttctgagaataacaaagaagattcagatattgcagcagagaatgaaaaatctgatgcagcagagaaggaaaagtctggagatgaaaatgaaatagaaggagaagatgcagctccccgccagaggagagtaaggcgcgagacataaatcctagttcactgagaaaaaaattcggacactaaagttcagtgcatggaatgaacaaatctgtcaaaattcatccatctgtttttggtatgtaagtcataggtaaaataggaggaacggtcagagaatctgcgtccccatcatgcgtggtggatttggataacattttttccagagttctgtttctaggtgtttgtcagacattggaagcatagc

SEQ ID NO: 2 - DNA, 1622 bp, Pinus radiata
gtgtggtgaccattgaaaatggcaggccgacgatcgcttttgtacgctgtgttcctgctgctgttcgctactctcgtctcagccgaagtctttttcgaggagcgtttcgatgatagctgggaaagtcgttgggtgcaatctgattggaaaaaggatgaaagcttggctggagattgggtgcacacagcagggaaatggaacggggatccaaatgacaaaggcatccaaacacatacagactatagattttttgccatctcagctgcgtaccctgagtttagcaacaaggataagacccttgttcttcagttttctgtcaagcatgaacaaaaacttgattgtggtggtggttacgtaaagttgttaagtggtgaaattgaccagaagaatttcagtggagagacaccttatagtattatgtttggaccagacatttgcggttacagcactaagaaggttcataccattctgtcatataaagggaagaaccatcctatcaaaaaagatgtcccttgtgaaacagatcagcttactcatgtttatactttcattcttcgaccggatgctacatatagcatcctcattgacaacacggacaaacagtctgggagtttgtacaaggattgggacttgttgccaccaaaaacaatcaaggaccctaatgccaaaaagcctgaggattgggatgataaggaatatattcctgatccagaagacaagaaacctgagggatatgatgacattccaaaggaaatacctgatccagatgccactaagcccgaggattggaatgacgaggaggatggtgagtggacagctccaactattgcaaatccagaatataaaggaccctggaagcctaagaaaattaagaatcctaactacaagggtaaatggaaggctccaatgattgacaatcctgatttcaaggatgatccagagctctatgtttttcccaatctcaaatatctaggaatcgagttatggcaggtcaagtcaggaacattatttgataacattttaatctctgatgatcctgaatatgccaagaagttagcagaggaaacatgggccaaacacaaggatgccgaaaaggaagcctttgacgaggcagagaaaaagaaagaagaggaggagaaagagaaagagtctgatgatgaggaggatacagatgaaaaggaggaaaaatctgatgacgaggatgcagatgaattagacgatgaacacaaagaagcagacaagaaagaacatgaattagacagtgaacacaaagaagaggataagaaagaacatgatgagctatagttgcttaatatatgcaacactgctttcatgtgggatggtaccatgaattggaaatttggagtcattgttttatcctctcaaattttgcaagagtttacaggtggtttctttgatgaatgcttgttttgaaacggctttacagaaaggagtaataattattgtagtctccctttttaatggtgagcaacattttttaaggactcttgcaagaaatgcttttattttcgaacagtgggcaggtttacccagcaagtagtcaatgaaaaataataaaactttcattttgcagaaaaaaaaaaaaaaaaaaaaaaaaaaaa

SEQ ID NO: 3 - DNA, 1860 bp, Pinus radiata
gcagctgttcttcataggttgcttaatgccattcttatcccacaagttcataggttgcttaatgccattcttatctcacaagtttatgtaaaaattttcacaggtagattgattctctctttctttcctgacccttttttggattccctgtccttatgaaacccaattaaagaggcaactaaacaaagtgctgggcctcacttggacttcttgtgttaaatgggtttttcccggcacttggattcatcatttctgagttgagtaaattgggtttgtaagaataaggacgtggagcagagcaggtgggtctggcttgtttcagcgcaacctgaaacaaagtcaggtgaactaggcttgtggtggaagcttgaagctcagcccagctcaggtggagcctcaggagtttgagtatattggttgaggcgatttgttcattcagggagattgttctatcaatggctccagatttgaaactcgtgtttgtgctgttgctactatctgctatgtattgttcaggatctttggatgtaaatgggaagagtatggacgagctgagtagtagtcaaggacagttgcgtttaggtttgagaaaggttttagaaaagaaagctactactgtaaccaatagtgacgatgttcgaccttctgaattagggaacatcacacccagcacaacacctcattctcgttatacttaccccatcacaacgcccactccccccacgatcataacaacaccccctgccataacaacaccaacgcctgttataacaacacctacaactcccacaactacacctgtcctcaatccccctacagcccctgtaactactactcccacaacccccacaaccaccacccctgctgtatcagggactcagagctggtgcgtggccaggaccaatgttccagaaaattccttgcaggttgctcttgattacgcctgtggtatcggaggtgcagactgtaaagcggtgcagcaaggagggcaatgctatcagccaataacagttgcagcccacgcttcctacgcattcaacagttattaccagaagaatagtaaggcacccgggacctgtgacttcggcggccatgcaatcattaccacaaccaatccgagctatgggagctgcacatatgcttcagggtcgagcactatcagcactcctcctcctgcaacaatcattactgcaccacctcctccagccacggttggtattgttgctgctccacctcctccagcgacgattggtattggtgctgctccacctcctccatttggcaccactccaactactaccactccagggtacaatgtcagcactccaaccgggggtattacttctcctattggtggtggtattaccagtcccacagtgggaggcattactggaggcctgggaccaagtgcatctacatacaatactacgccctcatacggcagcgcaccatcattcttccaggatctgccttcgtcatttatattattcctcttgtctttagttgtggctgtaatactaggctaagtacttcaaatgctagctctgtctgtttactagtgccatagctagcatgccaagcgatgagaatgatgttgtagaaatgctcatctttagtagctcctacaagctatttgcttttgttaagaggcctcaggtgaaaatttggttgggagatttttggagatgggcatagaattgcaggtcaaccctaaggggggcatattgttcccaaattttcatatgtacattgaatgctttgcaagagctggtacattccttgcccactcacatttgctatctcttcaacaaataatactatcttcatccatgctgtgtctctctaaaaaaaaaaaaaaaa

SEQ ID NO: 4 - DNA, 2498 bp, Pinus radiata
ctttaattttgcacttcccacgatgcaaaacgaaatcgtgttgcaacagtttaaccgtcgtggaaaggcatgactctgtatcttcctccaagtgtctaaaaatttgttatcctgtaatgaattgaatctgggcctattctgctcgcaccttcacacgtttggaatcaaacaacagcccaatcaacctttcggaatcagaccccagaacagccaactctataaattcatgaaaatattaattcctgaatgccagtgaatggatgatcccttccgtttccattaaaaattcctttgccatctttcaatttctggactgttgcttcacatgctccttgcaggagctctggaaatttcccttctgaaatgctttgaggtttcctctgttaatctggattctaacaccatttttggtaattagcccgcactccaaaggcaggtaagaaaagaatatacactccgtgatcacactgccaacggaaatctaactcgggaagagaaaactcgacgtcacccatgacgggaaaggggaaaatcgcaaatgaggggacaccaactatttatgactaaagccttctgaatgagcgtgctactgcaacctttcctgcaaaaaataaacaaatactgagtgagtcactgcagaacgcacatgtgccatcgcagcaacagcaaaacccacttcataaatttctcgcatttctctgcatgcgaggagatttgggtgtgtagaggctgctgtcaagggagtttcggaaatgggcagagcaggcctcagaacgagcttgttgtgtattctgatttttctttctggattggctctttcaaatgctcagtcaaaaataagttcctccacaacgggaatcaactatggacaagtcgcagatgacttgccatcgccggaactagtagtgggtcttctgcagaccaacagtatcaacaaagtaaaactctacagcgtaaatgagacagttctcaaagcatttgcaaacactggtatagaattgattgttggaatgggtaatgaaaacgttggcaacatgacagatccaactaaggccactgaatgggtaaatgaaaacattcgggcctacttaccagccacaaagatcacaggcatagctgtagggaacgaggtttacacaggaactgacacgcagttaatggcaaacctggttcccgcaatgaaaaacatccattcggcccttgtcagcatcggtgcagacatgaatattaaagttaccactccccattctcttgctgtacttgggaattcatttccaccgtctgctggttcctttgcatcaaacgtgaagagcctaatgaaaccacttttggatttgttgtctcagattggttctcctttcttcataaatgcttatccatattttgcatacaagggtgaccccagccagatatccctggcttatgtactattcgaaccaaatacaggtgttattgacccgaacaataatgttcattataacaacatgttatatgcacagattgatgctgtttattctgcgctgtctgctctaggatatgctaatatagaagtcacggtctccgaaactggatggccttcaaagggagacgccaatgaagcaggtgcaacccttcagaatgctcagacttataatgggaatttacttcaactgctcgctcagaaccaggggactcccttgagacccaaacttgttttgcaggcttacctgtttgcattattcaatgaggatatgaagcctgggccagcctccgagaggaactatgggctctttaagccagatggaactgcggtttacaatctgggattatctggaacattgtctactggttcaccatctactggttcaacgtctactgggtccttcacaactggtactccacctccagctgcttatccaagtactacggatagttcatactcctattattcttctgccaaggagacctattctgttatctccttctacaatcatcttctgcttttgggcctctctactttctttgttgttccactctttcttccatgattggagccatggaagttcagtagaaatttacatgtttccgttcattcaaaatcagctcaaacaacgaagattcagacaaaatccggctgcaggcaaataaatatatactctgctgacagtgaatcagaaggcttctgtttctacactaacaaactgatagctcaagcattctcatttactaaggatgataattcaaaattgtaacattgcaaacatcagcaaacatcagcatcaactctgttactgttacaagcaatggatgcgtcgctgatgctgcgggagagtaaatttttagtttactgcggttggtaatttgagtagttagtttgactacatttctattgtaaagccgttgtcgggcattgtttatctggccgagttagcgccaggaagctaaatgtaccaaatatttatttttattttattaagaagataaatttagtcgtctaaaaaaaaaaaaaaaaaaaaaaa

SEQ ID NO: 5 - DNA, 2097 bp, Pinus radiata
gttcaatttccatgagagatgggataagcacttcaatttccattacagacatctctgagatttcacaaattcctcattaaattttggatccttatattacattcttgcaagagcttcagatattcttgacattcttcctttcacgtttcctctgttaacctggattcccaagaacaaattcggtaacagacccgccattcaaaaagaggaaagaaaagaacatacactctttttgaaagaaaagaacatacactgtgagcactatcaccggaaatcattcgtcgggaaaagaaaagctgatgtcagccaagacggcagcaggccagattcgggaattgacgggataccaacagcaaaagccacagtattaatttgtgctatcctggaaaaaccacaaattctgagtatgcacatgtgccatcacagcaacagcgagaaccacagcattaatttctcgcagttctttgcacgcgaggagatttgtaggtgagtaggctgctgcaatgggagcttcagtaatgggcagtggagacctcagaatgttctgcttgttggctctggttttgctctctggactggttctttcaaattctgcgtccagcacaagttcctccgcaacaggaatcaactatggacaagttgcagataatttgccatcaccggaagtagtagtgggccttttgcagaccaggaatatcaacaaagtaaaaatctttagtgcaaatgagacagtcctcaaagcatttgcaaacactggtatagaattgattgttgcaattgggaatgaaaatgttggcaacatgacagatccaactaaagccactgaatgggtgaatgaaaacattcaggcctacttaccagccactaagataacatgcatagcagtggggaacgaagtttacacaggaactgatacacagttaatggaaaacctggttcctgcaatgaaaaacattcactcggcccttgtcagcatcggtgcagacacggatattaaaattagtactccccattctcttggtgtacttgggaattcatatccaccatctgctggttcctttacatcagacctgacaagcctaatgaaaccacttttggatttcctgtctcagattgattctcctttcttcgtaaatgtttatccattctttgcatacaaggctaatccaagccagatatccctggattatgtcctattccgaccaaatgcaggtgttgttgaccccaacaataatatcagctataacaacatgttatatgcacaggttgatgctgtttattctgcactgtctgcactggggtatcctaatctagaagtcacagtctctgaaactggatggccttcaatgggtgatgctgatgaagcaggtgcaactcttcagaatgcccagacttataatgggaatctacttcaactgctggctcagaaccaagggactcctttgagacccaaagttgttttgcaggcttacctatttgcattattcaatgaggatatgaaaactggcccaacctcggagaggaactatgggctctataagccagatggaacagcagtttacagtctgggatcaactggaacattgtctactggttctactagaactgtggctactgcttcttatcccactgctgctgatggtccatcctcttctgccaaggaaacctattctgttgtttccttctacaaccatctccagcttttgggcctctccactttctttgtttttctactgtttcggccatgattggagccagggaagtccatcagagatttacatgtttcccttcattcgacatcagctccaatgacgaaaattcagacgaaatcctatgacatgccactaaatatacagttctgacagtgaatcagcaagcagcatctgcttctatactaaaacatgacagcttgagcatcctcacttattaacgagtaactgttgtcacatacatggtgatggcattgaatctcagattcatggtgatgacattgaatctcagatttgtaacgttacgttcatcaacatcagctctgtagctctgttgccattacatgtaggcaaaatcttattctgcttctataaaaaaaaaaaaaaa

SEQ ID NO: 6 - DNA, 1887 bp, Pinus radiata
attccgggcgacagtgagggagggaaaggcaagaaagggatcgcggagggcgaacgaaggcgctctgagatatattttaagttcaaaggaagggaagaagcatcaatggaaataacatctgcaagaaaatcttcccttccattcatttcatttattgattttcgatgtgattcgagtgctcttacagaaatcagagcgctgccgttacgttgcattcagtgccgccggcttatggtatttgggattagttgcagaatggctatggtgttcattgtctgggctctcatggcgtttctatcagttgggttggaggattcgaaggcactggccattactggcagcacagtggggattaattacggacaaatagccgacaatttgcccccgccggcaaaagtagcagagcttctgaaggccttaaaggtaaccaaagtgaagctctatgactggaaccctgcgatcctgaaggcctttgccaattctgatgttgagctggtagtgggcatcggcaacgggtttgtggcgggactcatggacacgcaggcggccctttcttgggtaacgcagaacatccagccttatcttagcagtaccaaagtcacggggttctcggtgggcaacgaggtctacacgggcgacgatgctgccctcaaggcgaacctggtgcctgcaatgcggagcatccatacggccctggtgagcctcggtttggactctgcaatcaaaatctcgacggcccattcgctctcggtgctcaccagcagttacccgccctccgctggtgccttcgatcctgctattatgcagctcctgagggagcacctggacttcctggcggtcaccggagctccgttctggatcaacgcgtaccctttttttgcctacaaggacaacgctgggaaaatctctctggactacgcgctgctcaaacccaaccccggaactgatgaccccaacactcatctgcactacgataacatgctgtacgccatggtggacgcggtttactctgcgctcggcgccatggggtatgggaatctggaggtcagaatttcagagaccgggtggccttccaaaggggacgccgatgaattaggggcctccattcagaacgctgcgacgtataacaggaacctgctccagcgccttttgaagaatcagggcactcccatgaagcccaactctgctctccaggcttatattttcgccctcttcaatgaagacttgaagaacggccctacatctgagagaaattatgggctctttaagcccgatgaaagcatggtctataatatcggtcttgaaggaggactcacagttgaattctccgcttacgcttcttcagctcagatataatggcgctgcaatgtccatcgccctctcgctcctgctctcaggcctttgcacggtttatttcgttctacctcgattacatttctagctgtatattcaatgttattctgcatttaacgcttgcaatcccgggcaagcagtgaattgaatccagtgatcagccattggagcaatatgcagatgatctcaatcttaacacacagagaggccgtagactgtaaagtcagatggacgacccttctcttttaacatgacattgcccattcaattatgcgcagctcttgtaatggttatggccgctctgctcttgaacaaggcgtggcaattgaggattcaattcaagtaaataatttctactcgaatccctcatgtatatatatctatctgtgcgtggatcacttaaattaattatagctcatattttagctcacaccttggttacattgtctgtcttttttgttgttgcagaaaaatatttcatgttgcctgcggccgaataacagcagcgtgggatatctctgttacaagttctga

SEQ ID NO: 7 - DNA, 1867 bp, Pinus radiata
gcgagatgcgcatcctctttatgtacagacttctctgagttgttatcaacttcaccgctgcaacgtgttcaaatttttgcaacttgttacaacttttagagtattatgtcttttgttggaagggatgagttgatcagaattggatagctgagcagaggagttagattactgacatttcatagcatggagatcatagtaagagtgtctgcaattacgatattgcttccactcttcatacattgcatacgatgcggagaaagcataggcagaagcaggactttggtggaacattcgccagctctgggtgtgaactatggacagatggcagacaatcttccttccccatctggagtagcgaagctagttcagagtacaactatttcaaagctgagaatatatggagcagatcctgcaattcttcaagcctttgctaacacaggaattgggttacttgtaggtattagtaatgaccaaatcccatctctgaaccagctggctgtagcacagaattgggttaagagcaacattgttccttttgttcctgccactgatatcattgggatctcagtggggaatgaggttctgttcagtggagatagggttctgatttctcagctccttcctgcattgcagaacctacacactgcccttgttgaggtttcacttgatcagcaaattaaggtctctacacctcattctatggccatactttctgcatctgcacccccatctgctggacgtttcagtgggagttttgacatgaaagccctgcttgacttcctgcagaagataggagcccctttcatgatcaacccatacccttactttgcttataagagtgatcccacagatcgaactctggcttatgcactctttgagcccaaccaagggtcttatgacaccaatactggcctcaaatataccaacatgtttgatgctcagcttgatgcagtgtactcggccatgaaatatctgggttacacagatattgatatagtggtggcagaaacgggatggccatctgcaggggatccttcagagacaggcgctagcttgcagaatgcaattgcttacaatggtaatctgatcaagcatgtgacctccatggcaggtacccctatgatgcctaatcggtccattgagatttatatttttggtctcttcaacgaggacctgaagccaggaccaacctcggagcgcaattttgggctctttaaaactgatatgaccatggcttatgatgtgggcttgttacgatctcagagtgcaagtccgtctcctgctgctccacgcactggtggtcctgttgtagctcctcctacagcgaaagtttggtgcattgccaagcccggtgttgatgaaaaatctttgaaacaaaatttggactacgcttgtgggcagggcattgactgtaagcctattcaacaagggggtccttgctacttaccaaatacaatggcatcccatgctgcttatgccatgaatgcatactatcaatctgcaggccggaacagtttgaactgtgattttgcgcagactggaactgttacttccaaagatccaagttatgggggctgcgtgtactccacagtcaactcttaacggatgagacatcgtagttttatatttagtggactggccagctatattttcaaggatattatatgaagaagatatcaggtgaatgtttgaatttaattttgttttctaataaaggtgccgttgtaaacatgaatttaattccacagaatttggcaatatggcgagttgtgtgaacatgtctttcatttcgctgagcttcagaatataatgctagctatatatcatgcaataagaaacctctgaaattatgtttaaaaaaaaaaaa

SEQ ID NO: 8 - DNA, 1955 bp, Pinus radiata
gtatcattatttcagtcattatcgataatgataagcctcaaatatgaatcaatagtctcttagtcatttaatttatggttttcagtgtcgatgtgctctcctgccagggctccaccaatctcctttaggttcagtgtacatcgtctgaaaataagttgacaaggccaggtcaatgcagaagcctcctggcttggggaccctaagtgtgaaatcaatatattttcctcgagttcttgacctgttagcaacttcgacactgcaacttgtcctaatctttgctgtgtattatgtattttgttccaagtattggagtgtagcacagtggatggtagagaggaggatctagatcagtcacttttacatagaatggagatgatagtaaaagcaactacaattacgatcttgctaccagtcatcctatgttgcatcccatgtggagaaagtggaagcggaggcaggagtttggcgcagcgtttaccagccctaggcgttgactatggacaaactgcagacaatcttcctccaccatctgcagtagcaaagctggttcagagtacaagtatttcaaagttgagactatatggagcagatcctgcaattcttcaagcatttgctaacacaggaattgggttagttgtaggcattggtaacgatcaaatcccatctctgaaccagctggctgttgcacagaattggattaagaacaatatcgttccttttgttcctgccactgatatcattggaatctcggtggggaacgaggttctgttcagtggggatgggagtctgatttcccagctcctccctgcattgcagaacctacacactgcccttgttgaggtttcacttgaccagcaaattaaggtctccacacctcattctctggccatactttctacatctgtccccccatctgctggccgtttcaatgaaagttttgacatgaaatccctgcttgacttcttgcagaagataggggccccattaatgatcaacccatacccctactttgcttacaagagtaatcccaccgatcaaaccctggcttatgcactcttcgagcccaacccgggcttctatgacacaaacagtgggctcacctataccaacatgtttgatgctcagcttgatgcagtgtactcagccatgaaatatctgggttaccctggtgttgatatagtggtggctgaaacaggatggccagctgtgggggatcctacagagacaggggtgagcttacagaatgcaattgcttacaatggcaacctgatcaagcatgtgacgtccatgacggggaccccattgaggccaaataggtacattcaaacctatatttttgccctctttaatgaggatctgaagccaggaccaacttcggagcgcaattatgggctgtttaaagttgatatgacaatggcttatgatgtgggtttgttgcaatcgccgagtgcagctccatctcctcctgctccacgcactggggggcctgtgacaactcctcctacaggtaaagtttggtgcattgccaagccgggcgccgaagagcaaactttggaggcaaatttgaactatgtttgtggacagggcattgactgtaggcctattcaaccaggaggtccttgctattcaccaaatacagtggcaggccatgctgcttatgccatgaacgcatactatcagactgcgggtcggaacaattggaattgtgattttgcgcagacgggaactcttacctccacagatccaagctacggggcctgcgtgtacccgaccgtctaagatatgaatcaatcaatcaatcctagtgttttctattccacttgttgttcggtatatattttccaacttgtcttttcatatgagtgagatgtatgaggtacctattttcaaagttgtgatagcatatacatcataagatgtaatgtgtatgtttgggttttaaaaaaaaaaaaaaa

SEQ ID NO: 9 - DNA, 1269 bp, Pinus radiata
gggcatttccagtgagaaaaatggcagcctccaaagaccagatgaagatcttgctgctcggatgtgttgccatctactgttattcaattatcgcgggcggtgataaaataggagtcaacaatggcatggtgggagacaatctgccacctgcagaccaagtggtagccttaatgaaacagaacaacattgggaaatataggattttccaaggaagtccagaagtactgccggcttttgctaactccggcatcgatgtaatcgtgggaatcgaaaccaacagactgcaagaaatgtcttccagccaagatgcagcagacagttgggttaaaaccaacattgtccccttctatcccgccaccaatataaaatacattgcagtgggaaacgaggttgtgaaggtcaaggagaacgtgtcgtatcttcttcctgccatgaaaaacattcaaaccgctctgcagaacgccaatccgcagaacaagatcaaggtctccaccacccacgcctcagaatctgttataggaaatgccttaatcccgccttctaagggagtcttcttagacgacgtgaaggacaccatgagctctgtgctcaaattcctgtcagataacgaggctcctttcatggccaacgtctatccatttttcagttatgtcaatgaaaactggagaaacatctctctggagtatgctctgtttaagtccacgtctccggtgatgcaagacggagatcacagctatattaatctgttcgatgccatcgttgatactattatctcggccatggaaaacttgggatatcaagacttcccgttaatcattactgaaagcggatggccttctgctggcttgaacgtggccacagtcgacaatgctcaggcttataacaacaatctcatcaaacatgtattgtcaaatgcagggacacccaagaggcctggaaggagcattgagacctatatcttcgctattttcaacgagaaccagaagccaggggctgagacagagcgtcactttggtctcttcaaccctgataaaactccggtatactctgttaacttttctccatattgagttgcatgtcaatgccctaatcatgggcaccaagtccagctggacaagccctacttatctgtatgcaaaataaagtgatacatatgtgatcatcctgaagtgtgaattgtgtccaaaccttcatctcagtaatcttgttggaaatggaaggccttgacatttgtgcttgaaaatatatattgaaggtttaaaaaaaaaa

SEQ ID NO: 10 - DNA, 1880 bp, Pinus radiata
cgagtgttcgaagaatactatcaatcttgggcctttaccttcacagggtgctcaattcagaaaatcgatggaagccaaaacgaggccaacagcagagctggatttgagaaggggaatgggatttcgctgggcattcattctgctgctctcagttgcttcaatacagagcactgaagggttcagtgtcacgggaactgttggaataaactacgggcaaatagcgaacaacctgccacccccgtcccaggtcgtggagttgctgcaggcttccaatctgacaaatgtccggatctacgacgcaaatccacagattctcaacgcgctccgcaacaccagtgtggaaatcgtggtcagcctcggcaacgaatatgtggccacgatgagcgcccgcccggacaaggcccggcagtgggtgaaaaagaacgtggcagcctacattcccgcggggactaacatcacgggcgtccttgtgggcaacgaggtctacgcgggcaacgatacggtactgaaaaataatctgatgggtgctctgaagaacatacactcggcgctggtgagcctcggcctcgacaacaccgttaaggtctccacggcgcactctttcgacgtcttcgtatcctccttcccgccttccagttgcgccttcagcgacaaatccgtgacttacatgaagcagctcttggactttctttccgcaacgcacgcgccttttctggtcaatgtgtacccctattttgcctacaagggcgacccgagcaacgtccctctggactacgctctcttccggcccagcaatggcgtggtcgattccaagaccaatttgcactacgacaacctgttctacgcccagatcgacgctgcgtactcggcgctcgccgctctgggctacggtaaggtcgaggtcagggtctcggagacagggtggccctccaagggggacgatgatgagctcggtgccacgcccgagaatgcaaagacttacaatgggaaccttttggagaggctccacaagaaggagggtactcccctgaagcccaatgtgagcgtgcaggccttcatttttgcgctctttaatgagaatttgaagtccgggcctacatccgagagaaattatgggctctttaaaccagacggaaccgagacgtatgaccttggcttgaaaggattgaagcgaatagtgtcctctctgcctccgccccccactgttgccacaggcaacagcagtaattccaccccaactacagctatcacctcccttaccgctcccagcccctctgtgtccacaggtgacggtactaattccagttcagacagctcctcagctaagggaatgcattcactggtcttcatttccttctacctccagattttagctctctcttcttttatcagtgttctgattttggaacattagcaaacaaaattgattattctttcactggaatatctacttatatattagagtagaaaacaaccacaatcttctcctctcaactcggtgccagattgagtctaatccaatcagggagttcctgcttgtattaaaacaagattacgcgagtcttgctatacaacgcacatgttacggacaaatactccattcttgagaattaatctttgtaatgctggcctgggtctgtatatgaatctgaaagttcatggtgctctttcttattgtgtcttgctatcatcttagagcattaatcaagtttgtaggcatgctcttgaattaatttttgacgtcattttttgtgaatgtgttcgttcaatgtgacttcaatctggaatgaatctgtaaattcttcaagggatgagaattatgttgtcattactcagagccagataatggttttggaatcaaaattttcgtaaaaaaaaaa

SEQ ID NO: 11 - DNA, 1467 bp, Pinus radiata
atcaatcttgggcctttaccttcacagggtgctcaattcagaaaatcgatggaagccaaaacgaggccaacagcagagctggatttgagaaggggaatgggatttcgctgggcattcattctgctgctctcagttgcttcaatacagagcactgaagggttcagtgtcacgggaactgttggaataaactacgggcaaatagcgaacaacctgccacccccgtcccaggtcgtggagttgctgcaggcttccaatctgacaaatgtccggatctacgacgcaaatccacagattctcaacgcgctccgcaacaccagtgtggaaatcgtggtcagcctcggcaacgaatatgtggccacgatgagcgcccgcccggacaaggcccggcagtgggtgaaaaagaacgtggcagcctacattcccgcggggactaacatcacgggcgtccttgtgggcaacgaggtctacgcgggcaacgatacggtactgaaaaataatctgatgggtgctctgaagaacatacactcggcgctggtgagcctcggcctcgacaacaccgttaaggtctccacggcgcactctttcgacgtcttcgtatcctccttcccgccttccagttgcgccttcagcgacaaatccgtgacttacatgaagcagctcttggactttctttccgcaacgcacgcgccttttctggtcaatgtgtacccctattttgcctacaagggcgacccgagcaacgtccctctggactacgctctcttccggcccagcaatggcgtggtcgattccaagaccaatttgcactacgacaacctgttctacgcccagatcgacgctgcgtactcggcgctcgccgctctgggctacggtaaggtcgaggtcagggtctcggagacagggtggccctccaagggggacgatgatgagctcggtgccacgcccgagaatgcaaagacttacaatgggaaccttttggagaggctccacaagaaggagggtactcccctgaagcccaatgtgagcgtgcaggccttcatttttgcgctctttaatgagaatttgaagtccgggcctacatccgagagaaattatgggctctttaaaccagacggaaccgagacgtatgaccttggcttgaaaggattgaagcgaatagtgtcctctctgcctccgccccccactgttgccacaggcaacagcagtaattccaccccaactacagctatcacctcccttaccgctcccagcccctctgtgtccacaggtgacggtactaattccagttcagacagctcctcagctaaggtagtgctttgatatttcatgtctgtgtttggctgtttgtatttagtctttgaattctgcaaatcatttaagctttgtgcatgtgttttgctcaacaactgtgaagattagaatctttataaccattttgaggtcctgcttctggttttaaaaaaaaaa

SEQ ID NO: 12 - DNA, 1681 bp, Pinus radiata
ggctgaaacaatgccaactccaaaaccgaagattttctggcttctgttgctcattcttggactcacaattcacgcctatgcagaggattacaccatcggtgtcgcttatgggcagtatggtgacaacctgccctccgtacaagaatctattgacttgatccagagattgaaggttggcagggttaaaatctacagtaccaatccagtaatcctcaaggcgctctctaacaccggtattaaggtctctgtgatggttaggaatgaagatattgccggtctctcggccagccagtcagttgcagacaaatgggtcaatgataatattgttcccttctatcctgcaaccgagatcaatataatcctggtggggaatgaaattttaacagactactccaataaacagacctggtaccagctagtgcccgctatgcagagcatctggcaagctctggttaattataatctggatcatattaatgttggaacccctttggctatggatatgcttggctcttcagttccaatatctgcatttcctccatcagctggtacttttcgggatgatattgcagaaactgtgatgaaaccaatgctagagtttcttcatagaacgaattcctacttttttatggatgtgtattcttactttccttatttgtttgatcccgaagatatatctttggaatatgccaattttggagaaaatgacaaaaaatacactgaccccaacggcctcgtgtataccaatatgctggaccagcagcttgatgcggttgtagctgcaatgagcaaaatgggttatgatgacattaagttggccatagctgaaactggatggcccaatgccggtgacattagtcagttgggtgccaacatcaattatgcagccctttataaccggagggttataaggagaatggttgcagaccctcccctcggaacccctcgcaggcccaatcaattcatccccacatacatttttttattgtatgatgaggataaaaagtctggaccggggactgagaggcattggggttttgtgtatccaaatggaaccttgatgtatgagattgatctcactgggaagctccaggattcggactatgggcctctccctcctccgcctccaccctacaagggcaaattgtggtgtgttgcagatcccactgcagatgtttatgccttgccctccgctattgattctgcttgcagtcagggagacagcacctgcgatgccatccagccaggggagccttgttatgagcctaacacggttattgatcatgcatcctatgcattcaacagtaattggcagcgatccaagaacttttattccggctgtgacttcaataaaactgcaaaactagtcacagaggaccccagtcatgggaattgtatatacgaattcgtagactgcgtccagaagtctgtgctttgttgagacgctttgcctggttgaaatggttatggtagcagtatttgcctcggttttagtagttcagaagatgatcttaaaggaccttgtcacttgttactcttgtaattgatcgtagggaatccttactctattatattttcatatatatatgaagttttatttaaattttgtataaaatttaaatgatttatgaattataaatatgaattgctaagattttataattaaaaaaaaaaaaaaaaa

SEQ ID NO: 13 - DNA, 2162 bp, Pinus radiata
aagtcgcttttcagaggtacgggggttaagtcattttgagggaaatttgtgggcttcctgtataggtttcagagcatctgttgcctgtggggtacaggctgtgcgccattgttgtgtttcaagctagggtcatagctgtgattataatcatataagaagaagcgctggggtcttgaataaatgcaagtggggattacgtagtgtattgggttgtgcaaaggaagtggtgaagggtccatctggttatacattggattggaggtggtgaagggcatatatatatatatatatatatatatatatatagttgtgtgttttattgtaagcagtaggactgtggagtactaggattatagctcaactgattgtaagactgtgtttttacaaaggtggactaatgggggaaaaacttgggagtagaggtctgctcatcctgctggcttttgtgttatgcatctcttttacagctgaagcaataggtgtgaactatggaagaatgggggacgatcttcctcctcccagtgaagtggcgaaattcctacagaccacaataattgacaaagtgaagctcttcgatgcagatcctggtgtcttgcaggcttttgccaatacaaatataggggttgttgtcgccgtggcaaatgaccaaatcgcagcccttaacaaactgcctgcagcacaggattgggtgaagaaaaacgtggctcctttcgtgccagctacaaatataattgccatatctgtgggaaatgagattctttccacgggagacaaagtgctaatatcccaactcgtccctgccatgcaaaatcttcatactgctcttgttggtgcctctcttgacaagcaaatcaaggtctctacacctcattcgcttggtattctgtctgcttctgagcccccatccataggaaggttccgtcgaggctatgatagagttattctaaagccattgttgaactttctcagaacaacaggggctcctttcatgatcaacccttatccatactttggctacacagataagaccttgaactatgctctgtttaagccaaatcaaggtgtttttgacaataatactggaatcacctataccaacatgttccaagctcagttggatgctgtctactcggctatgaaacttttggggttctcagatgtagatatcgttgtggctgaaaccgggtggccatcagttggagatcctgaccagacagctgtcaatgtggagaacgctctttcctacaatggcaatctcatcaaacttgtcaataccaatgcaggaactccgttgatgcccaacaagacctttgatacttacatattttctctcttcaacgaagatctcaagcccggtcctactgcagagcgcaactttgggctattcaaaccagacatgaccatggtttatgatgttgggctcatgaagtctgagagtgcaactcctgcgcctatttctacagcgccagtaacaccggccaccccagcacctatttctacagcaccagtaacaccgaccacccctgcacctatttctacagcaccagtaacaccgaccacccctgcaccagttacaggaacagataaatcttggtgtgttgctaaaccagatgcagatcccaatgtactccaagacaatatagattatgcatgtggacagggagtggactgcagtgccattcaagcaggtggccagtgctttactccaaatactgttgtagcacatgctacgtacgcaatgaattcttattaccagctaactggtcgccacagctatgattgtgattttgctcaaacagggtttcttacacaggaggatccaagttatggtacgtgtgtatacccgacaatatagcgtacaattcaccttcggaaattttttcaaagctcattgaagaagcgtattagcatcatcggctaatatttaggatagcatttatttaatttaactgtgttatatagtacttgtaatcagtaacagctataaagctgcagaattcaggttatagtggaccatcagtagggattctggcagtggtgctaatttatttgtatacgatttgcctttacgttttgtagcgatgtgggtgttatcgatgactattaaatatattcatgtaacgcttgagaattataaatttacctgttttataaaaaaaaaa

SEQ ID NO: 14 - DNA, 2003 bp, Pinus radiata
gagaaacgaggcaagcccacagcattcctgagaagcaaacacaaaactcgagattcatccatggatgggatgcatggatcaaaagtttgtagatatagcagaatgcaacgcacagttcccatgctttgtactctgttggtagcagccctggggcatctggttatactctcagcagcagcaaattccggcgtatttcctccattttacacgcgagcgcttggcatcaactatggccgcgtggcggacaacctcccatcgccctcctctgccgtggccctcatcaaaaacctgcaagcgggctacgtcaaaatctacgacgccgatccccaggtcctctcggcgctctccaacaccgccctccaagtaacgatcaccgtaagaaaccaagacatctccaacatatcgtcgtcccccaccgtcgccgagcaatgggttcaagccaacgtgctcccccattaccccgccacgctcatcacggccatcatggtgggcaacgaggtgctctccgactaccaaaaccaggcaacgtggctcctcctgctcccggctatggccaacatccacgcctccttactcaaccacggtctcgctgactccatcaaagtcacgacatccctagccatggacgtgctctcttcttcctacccgccctccgagggcaccttccggagcgacgtcgcctccccggtgctgcaaccgttgctcgatttcgcgaaccggacgggctctttcctcttcctggacatctacccgttcttcgcctggagcgcgaaccccgccaacgtgtctctggactacgctacgttgagcctggaccgcaacacggcggaattccaagacgccgggctcagctactccaacatgctggacgcccagctggacgccgtgctggcagccatggaccggctcggattccccagcgttaatgtggtcattggcgagacagggtggcccacaaaaggcgacgacaatcagccgggcaccaatgtcccgaacgccacgctgtacaaccagcagctcgtacaaaaggccctcgccgacccgccacgggggacacctcggcgccccggtgccttcatccccacctacattttctccctctttaacgaggaccagaaacccggccccaccacagagcgcaactggggtctcttttaccccaatgggacacccgtttaccccatcgttctctccaatgacgcccctgtcctttctcacatctccgttccctctcagaacaacgccccgtttccgtcgacccctcctggccccgttgctgctgttcagtggtgcgttgtctcacccgttgccgtggctcaagtggacgaaactagcctgcaagctgcactagattatgcctgtggcgccggagccgattgttcgcttatcgagcccggggagccctgttatctccctaacacccttgtttcccatgcttcctatgcttttaacagttactggcagaagaacaaggccgcgggcgctacctgtgacttcaatggatctgcggtgctctcctcctctgatccaagtgtcggagattgtgtgttcgatcatatgtagaagataaaagtgagaaaactgacagactttgtacgaataggcggggcagatcaggccgtttttactgttatttcataacgatagaatcaatttatatactaaatagttcgtctactgtgaaatgataatgttgtatatacattacgtatacactatggtgaaagtatttgcaatttttgttaggtggaatccaataaactctatgatattgggtacctgatctatttaaattgtaggatttctatagataatgtaaagccgtgggctctgttttgatggctaacggatcagtatttgtcttgtgaattggggtgagtccctcttggccagttgaaatcaaaagcatgggccaggcaaggtgtgaaacgatgaaatttcacattattgggatcgaaatagaaagcaataagcatagtatatacatttttctaaaaaaaaaa

SEQ ID NO: 15 - DNA, 2302 bp, Pinus radiata
tgaggaaggtgtatgtagctttattcatccctgtgactggactagacagtatcttggtctaggaatcagaagcaaatttcagacagaaagaagttcgtatgggtgtaatgcacagagaatgcaagaattgatcattctaagccaataagggtagtctataggcacattgcaggtctgaggactgtatctctgttcaagatggattgtaggaggctgcattcaagtaaaactctactggttgttctctatatttcggttcttttaattccaacaggtaagaactcgatctaagaacttcattatccatcgcatatttatacagacactctgtgttttgaagcatcagtggctgcatgttgtgttaatgtgggattttgaaatttaaagggttcaggcatccatttaggccgaacatggggttaatgtgggtcatgtttgtatgttctttggtattgcacattgcaggggcaaatgagccggaggcatcaccacagccaaaccctggaattggtgtaaactatggaacggaagggaacaatttgccatcaccgaagcaggtagccaagatgcttggaaagaccattgtcaatagagtcaaaatctacaactcagaaccctctatactgcaagcatttgccaacaccggcatcgcagtggttgtgggtcttgaaaatgagaaagtgcagaggataagtgaaagcccaactgcaggccaagcttgggtggctcagaggattgctccttactacccttcaaccttaataattctgatcaccgtagggaatgaggtccttacaaatagtgatgggtcattagactctgctctagtgcctgccatacaaaacattcattctggattggttgctttaggattggacgacaagattaaggtatctactccacatagtatggctatcctttcaagttcctttcctccttcggcctccacatttgctactagtttgctaccaattatgaagcctctccttaaattcttggatgatactggcgctcctttcatggttaatgcctatccttattttgcatacagagacaatcccaaagaagtttcattggactatgtgctgtttgggcagtctccaggggtttcagatccaaaagggttcacctataacaatatgctagatgctcaaattgattccatttactctgctatggctgctttgggtcacaatgacactatccctgtaactgtctctgagaccggttggccttccaaaggagacccagatgatataggagtgaatcctgacaatgctagaaactataataccagagtcatcaaacatgttacttccaatgcaggaactccaatgaggcctaatagagtcatagagacctttatttttgcactttttaatgagaaccataagcctgggccaaccactgagaggaactttgggctgctaaacccagatggttcaaaagtatatgatgtagatttgagttgtggttggtgtgcatctcctcctccaccatattcgcctcctgcaagcccaccgcctagcccaatttctttattctcaggaccaccaaaaggttcaaggggaggccttggttttgctgtttattgcattgccaaaccaagttctgatccatctgttcttcaagagtccttggatttttcttgtgggctgggtggtgcagattgtgcttcaattcgtcagggtggaccttgttataatccaaataccgttcatgcccatgcttcatatgcaatgaatagttactatcagattcacggcagaaactactggaattgtgatttcaaaagcaccggtttggtcacatttactgatccaagctatggatcttgtcactatcctcaagaataagcatcaaataaaactggcaaggtgctttcaataactctgttatcccttcctcttggatatcaatggttgtaaaagccagtcctcttgccagaacagtctcagtggactgactgcaatactcattatttgaaccagttggtagttgtgatggtgtgcttacaaacgattttgtctgtctgagcaattttagcaggttatccaaaatgtgattaaactttatcggcacatgtattaatagaaccactgggagcttattcagcatatgtatttatagtaccactgcctaaatatgaaattcaggcagcttcttctgcttctccagtgaagctttgtgtttatgtttttcgtccgctataggctaagcacaggctatcgcaacccagtggattggataatttgtattgttttgaacgtatggagtacaatgcttatattcaaaaaaaaaa

SEQ ID NO: 16 - DNA, 2009 bp, Pinus radiata
gtaaatttggctcttgggttgtgctggtacgctgaagagatatccaggtcatatttcctggtaaaagacggaaggaataacttatatttcatgacagaagacggaaaaggataacttccgacaggacaggaatcgagctcgcgatcacaaaacgaaatgggggcaggataatttggcttcaaattcacataaagatatatattgtagaggagagcagagaggaatatattaccagagcagcagcagaagaataagggccagtctgggcccaggaaggactgcagattggagcagcagcacattttattcagttcccattgctggccaagacaaccaattaattttgccattgatcatattgttgctgcagtcggtggggacgaaggagggactaagcattggcaaagtcggtggggacggaggagggactaagcattggcaatggcaatggaaggacccagatcaggattggcattaatcatttccaatttcatcttcttcttactctcaggtagcgcaaggactggtacagcgagcaacgcaacaattggcatcaattacgggcaaattgcagataacttgccgtctccacagcgcgtagcggggctactgcgctcgatcaatattatcaagaaagtgaaattatacgacgcgaaccgggaggttctagaggcgtttgcgaacaccggaatcgaatttgtagtggggctgagcaacgaatatgtgggcaatatgacggatcaggcagcagcagtggactgggtgaaggaaaacgtgcaaggttacttaccgggcaccaacatcacgtgcattgccgtgggcaacgaagtcttcacgagcaacaatacgctctggatgtccaatcttgttccggcgatgcagaacatacattcggctctggtaagcttggggttgcaggactccgtgaacgtgaccacggcgcattcgagctttgtgctggccacgtcatacccgccctccgcgggcgccttcaaaccggagctcaccgccttcctgagaccgcttcttgattttctttcccagacaacgtcgcctttcctcatcaatgcctacccctattttgcctacaaggataacgccgatcaaatcccgctggactacgttctcttccagccgaacgccggaacggtggacccaggcacgaatctgcactacagcaacatgctccacgctcagatagacgccgtttattctgcgctctcggcgctcggttactccgccatggaaatcaaggtttccgagaccggatggccctccaagggcgactcggacgaagtcggcgctacgccggaaaatgcccggatttataacggcaacctcctccagctcctggcgcagaaccaggggactcccatgcgaccgtcggttaggctggaaagctatgtctttgccctcttcaacgaggatcaaaagcctggcaagacctcggaaagaaactacggcctctttaaatccgacggcagcccagcttatgatgtgggattgcacggatccctgtcaggcgcctctgctaatccaatcctctacagcaaggtcgtggtttcgagcctctgctccttgtttcttctattctttttagggctttaaggcggagaacacgaacccgaaaacgaacagtaacaggaacccgaacgcctgaattgttgctgctattctcaatcaacaaaagatcggagcaataacagcctacacggccatggcgaaaaaatctgacggtgtaattgcagatggaatcagctaatttgtcacaattcctttgaaacaggggatgctgtgcgggcgccggccatattccagtcctcctgtgtccaacataatatccgaccatagcatatattacaggaaacggttggatcgttttaaaatacgaaacgactgtcgttactatagttatcagagtgctgaattgcttctctgcatctttggctcactcgatcgtgggattccgccaaaaattaatatttgttgcgttatttttaaaaaaaaaa

SEQ ID NO: 17 - DNA, 922 bp, Pinus radiata
tagatcccgcaagtccttctgcttcaaacatattgtaaggagggtcatcaaatagcagagagcagccaagtcaaaagctccttgaatttctacaatggcacgcatttctttcaagctcaggctgcaagccctctttctgttatggcttttcacatcctgccccttgtttgctgcaggagcaaggcatgctaggatcctcgaatcacagagggataacccagggcaaaggctatggtgtatagctaaaccttcagcttatgagagtgacttgctggtgaatatcaactatgcatgttctcagtctggagtcgactgctcagtgctgcagaatggaaatccatgctattaccccaatactccagtatcacatgcagctgttgcaatgaatctgtacttccaacactatggacgcaattactggaattgctacttcaacaacactggacttgtggtactcaccgatccaagttatggaaactgtgaatatatatcgcagtgagtgatgagtgagaggttatggaaactgtgaatatatatcgcagtgagtgatgagtgagagattgttacagaagctttgagattggttatatccagcatttccaataaataaatttcagcagattgggattccaaacaaagaaattcaaccatagggattttaatgtgtttccagagataaaccagagattttttccaaaaatctggaagcgcattatcagcatttagcatctccagtaaggaaattcaacgttaatgctattgatatgtttacagagaactacagtatttctgtatgggtcgtttggtgagtattattgtatttgactacgtaaattatgtaaagcagagtgattctttaagaatattttattttcctgcctaaagtatataaagcaaaagtgattcttggataaaaaaaaaa

SEQ ID NO: 18 - DNA, 2195 bp, Pinus radiata
tgtttttcacaaattccttatctagtttgcaagttcctcgtcatttattctatgtctagttttgaattagacattggtgacttacatctctgattttcacaaattccttaccaagtttgcaaatttctcgtcatttatcaaattttggatgcttcatatccatagaagagccctgaaaaattcttgcccagctttcaccctttcagtttgctgtccagtggagggacaccatttatcactaacgctgtgcaatattgagtacctgcaaagagcatatgtgctatcacagcaccagcaagacccactcgattaatttctcgcaattttctgcatgcgagaaaatttgggcacgtagagggtgctgccatgggagtttcactcatgggcagaggaagtctcggaatgagctgcttgtgggctctggttttgctgtctggactggctctttcaaatgctctgtccagcacaagtgccaccacaacaggaatcaactatggacaagttgcagacgacttgccaccaccggaactagtagtgggtcttttgcagaccagcaatatcggcagaataaaactctacactgtaaatgcgacagtcctgaaagcatttgcaaacactggtatagaattgattgttggagtggcaaatgatatcattggcaacttgacagattcaaactcagccactgaatgggtcaatgaaaacattcaaacttacttaccagccacaaagatcataggtatagcagtagggaacgaggtttacacaggaactgacacacagttaatggcaaacctagttcctgcaatgcaaaacattcattcggccctagtcagcattggtgcggacacggatattataattagcactccccattctcttggtgtacttgcgacttcatatccaccatctgctggttcatttcaaccaggactggagagcctactggaacagcttttggctctcctgtctcagattggttctcctttcttcataaatgcttatccatactttccatacgaagcccagccaagccagatacccctggattatgtactactcgaaccaaatgcaagtgctgtcgttgaccagaacaataatgttgtctataagaacatgttatatgcacaggttgatgcagtttattctgcactatctgcactaggatatcctaatatagaagtcatagtcactgaaactggatggccttcaaacggtgatgccgatgaagcaggtgcaactcttcagaatgcacagacttataatgggaatttgcttcagctgctggctcagaacaaggggactcctttgaggcccaatgttgttttgcaggcttacctatttgcattattcaatgaagacatgaagcctggcccaacctccgagaggaattatgggctatttgggccaaatggagttgaagtttacaatgtgggattaactggatcactgtctattggtaataaaaaagccgtgtcagttggttctcccactggttctgctgatactccatactacaatactgcttctgccaaggaaacttgtactgatatctccttctacaatcatctccaggttttggccctctcttctttcttggttcttctactgtttcttccatgattgaaatttgaaaccatggaagtcctgtagaaagttgcatgttcctttcatttcattcaacatcagctaagacgacgaaactcagaggaaatcttgtggtggataactaaatatattcactgcagacagtgaacgagcaagcatctgcctttacatcacatgctgataacttgagcatcctcatttattaacgaggagctgttgtcagatacatatcagtgagtcccataattgcaacaatgcagacatcagcatggccctggctttacattacggattttattttacttttttatatatcgagttaaaactaaagtcatgggctagtatttttttagttaatgtattttattcacttatactatatttcctaccaaatatagaaattacagctctccctagtattggtattgggattggaaattacagctctccctagtattggtattgggattggaaattacagctctccctagtattgggattgtaaaagcagcttcttatttctttcaatgtaataatttgatttaaaatattttataataaaatatagttatataataaaaaaaaaa

SEQ ID NO: 19 - DNA, 2124 bp, Pinus radiata
gagagactggaccatttatccggtgggaatactgtgatttgtacttttgagcgcattgtttggcatagattccattgtcatttcaattactcctttgtgcttttacttcttcaggctctgatgatttcggtcccaaggcctcgagtttgggtgttttgggctgagggattgagattagaatagtagcatggcgctgtaatgggcattgtggcttatcgggcattaaggcattagtagtatgactgtttcttaatgggtattgccattgaatgatgtaatgaaaacccattgaaggagataaatggggatgctgtattggacaatggataagctgctgctgctcttctgggtgttattgctgatgcttgctcagtcgccagggttgacaagaggaagcacggtgggagtttgctatgggcgtgaaggcgatgaccttccaaccccagataaagtagcccaactagtgaagtcaatagctctcaaaaacataataatctatgactccaatgtgcaggtccttcaagcgtttgcccacactggcattgagctcattattgggatacccaattcagatttgcttggattttcacagtatcagagcacggcagacacatgggttactaacaatctattgccatactaccctgccaccatgataaaatatatagctgttggaaccgaagtgactgagagcacaattaatgttacatcccttgtcgttcctgcaatgcgcaatttacagacagctctaaaaaaagccggactggaccaaaaaattaaggtctctagcacccatgcacttagtatactttccagatcatttccaccctctgcaggggcatttgacagtaaatatgcatttttcctcagccccttgttgcagtttcttgctcagacacaatctccctttatgatcaatgtttatccctactatgcctacagagattcccctcgcaaggtgtccctggactatgctttattcagacctaacgatggtgtcattgaccaaaacacgggtcttgtttatacgaatatgtttgatgcgcagctcgatgctctcttctttgctttagaagcccttaactttaggtcacttagagtaatggtgactgaaacagggtggccctccaagggaggctctaaagagcccgcagcaactccagacaatgctgctacttacaatggaaatctggtcaggcatgtgataaacaacactggaactccttcgaggcctggccaggagattgatacatacgtttttgctctctttaatgagaaccggaagcctggattggagtcggaacggaactggggactcttctatcctgatgaaacaaaggtttacaatgtagatataagtggcaccgggttgccctatgtggctactgggggaaacttaacgtctgttgatggaacctcctggtgtgtagcttctccatcagccaaagaatctgacttgcagaaggctctggattgggcttgtgggtctggtaatgtggactgttccccaattcaacccggccaaccttgttatgaaccagataatcttgcttcccatgcttcgtatgcctttaacagctattaccagaagaatggagcctcatctgtggcttgcaattttggtggaacgggcaatataaccaccataaatccaagctatgaatcttgtgtgtatacaacatctagaaatggcttagcgaatacaaccagtaccctatcctcatccggtgtagactccattgcttctttttcatggctaattggatgggtaacaacattattcctggttcacctcttgacaatactcaaatggctatgaatccattcatgacctgaaagcactttttggtgcatgaaattttctctatggttcatgcgcttagcatcgatagattacttctagcctacggcaaagtatttttgttatgtaaatttggtatctgaggaaagaagtagaagggcaagatcttcagcattgattcttttttgtgaaggcaaggaattgcttgaactttgcctctattgaggtgttgtatcatgtatgtattatttattcactaagtaatggtagaaggtcaaggctctgttaatataagagtacaattcttgtaagcaaaaaaaaaa

SEQ ID NO: 20 - DNA, 2030 bp, Pinus radiata
gttttgacagagaagagcgttttacgaggtgaatttcatcatggaatctgtacatcattgagacgctcggattgcagttccttggggccttctaaagttcggagttcgaactgagtctggcggatttccaatgccggcatacggttgcctctccttgacaagctaggccagtcatctggttcgtctggatctcgggaacccgccttatacatttatacttatcttcttcatcttctcttaaaagtattctatgtgcccaacagtcccaacttcagcacaagggaaagcaaccatcattcctcgtcattctcattctttatcagagtatttagaagtcccagtaccaaggggaagcgttgctgttgctgttggttgggtttgttgtggccctcaccaagtcctggaactgtgacaaggatgacgttcttgttttgggttttggtgatatttgtattggtgggctgggtgcaaggactgggagtgaattggggtacgcaggcctcgcatccactgccacctgacgcagtggtggagatgctcaaggacaatggcataacgaaggtgaagctgttcgatgcagatgagcacacaatgaaagccttggccaacagtgggattcaggttatggtgggaattcctaatgaccagttgcaggtgatggccactagtacaaaagatgctgccaactgggttgaaacgaatgtcactgaatttaacttggacggtggagtggatatcgggtatgttgcagttggaaatgagcctttccttaaggcatacaatggtacttttatacagtatacttttccggctcttcaaaatatccagaatgcgctgaacaaagcagggttaaaaaatattaaggcaacagtacctcttaatgcagatgtgtatcagggagatacaccatcggagggacaattcaggccagatattaatgatctcatgatacagatttgtcagtttctggctagcaatggtgcaccttttacagttaatatctacccatttctaagtttgtacactaatgaaaactttcctgtggattttgccttttttgatggtactggccagccagtgatcgatggaaatatccaatatacaaatgtgtttgatgcggctcttgatacactcttttgggctttaaagagggcagggttccctgatttgcctgtccttgtgggagaagttggttggcctacagatggtgataaacatgcaaacatcaattttgcacagcgctttaatcagggccttttgaagcatataatgaatggtcgcggcacgccattgcgacctcaaaacattgaaacttatctatttagtcttgttgatgaagatgcaaaaagtatagcaccaggtaactttgaaaggcattggggcattttccagtacgatgggacacccaaatatgcacttgatctgtcagggcaaacacagaacacggcactggtttctgccaagggtgttaaatatttgcctagaagatggtgtgtgttcaatccgagtgcaagcccttcagtgttgactcagttacctgatagtattacctatgcttgtacacatggtgattgcacttctttgggatttggatcatcatgcaacagcttggattatcaaggcaatgcatcatatgcatttaactcatactatcaggtgaacaatcagcagaatggtgcttgtgggttttctagtttggccatcgtaactgagagtgacccatcacaagggacctgtaaatttgagatccaaatagcagttagtgcagcaagcaatactatgaacagttacctatattctctcatttctgttgctggggctgtggcagttgttcttttgtcagttttataatactttctagagttatcaatacattctttgatatatggatgccagcagcttttctttgaatgctttgctatagttctcttactcggagaacattcttacatggagaacgtgcagtttttgtaacattgtctagctccaggaataaacaatctgcaagcaccatcaccttaaaaaaaaaa

SEQ ID NO: 21 - DNA, 2325 bp, Pinus radiata
gttatggtcctcgcttctgaaagctgtgaaagagctcagcacacagaggcactaggattttgctggttcccagaagttggagaatgaacgataaaatgcccctctatctgctctatgtattctactgtctagctatattcgttattccaactgaggctgggagagaatggaattctattggtatcaactatgttcgtgcagggaaaaatcttctctcccctgccgaggccgtttcactcatgaaagcccttaaaataggcagagtgaagctgtatgattctgacccagaagttctcactgcgttggccaactcgggtctctctgttgtaatagctgtgaagaatgaggagattccaaccgttgcttccagcatattgaatgctgatgagtgggttaaacaaagtgttttagcacactatcctgcaaccagaattaatgccataactgttggaaacgaaatcctcaccgactacaataatcaggatagatggtctaagctggttcctgctatgcagaacattcacagttcacttgtacgttggaatcttaataaaaggattaaggtgactacaactgtagccatggatgctcttaactcctcatcagctccttctttggcaaggatcagggatgacattgcagaaagtgtgatgaaacctctgctacgcttcatgtccaattcaaaatccttctattttgtcaacgcttatccatattttgcatgggcagccaatgccaataaagttcctgtagattacgctatatttggagcagctaaagaagcagtccaagatggaggattgaagtatacagacatgctttctgctcagttggatgccaatttagctgccatggaaaaattgggatacccccatgtgaaaattgcaattagcgaaacaggttggcctgcatcaggaggtcctggagcaaatgttgatttggcagccacatacaacagaagggtagttgtaagaatgctggcaaatccacctttgggtactcctagaaggcctagaacttttgtacccacttatctctttgctctatttgatgcagataataataaacatggcacaacaagaaactggggtatgctgtacccaaatgggtctcaggtatatcccgtagacatgactgacaaacttaccgatttggaatttgaatccctcaagtccatcaggcctttccctgcccggccaactcctatccgctcatctatcagtaggtcttcccctttaactggaagttatccaagtcctgttccctcatattactctggtcctcctacattagtcaatcctccagcggcttcacccagtaccgataatatacctttcagttccccaataccttctgtgcatcctaatcctcatccaactatcaatgtgccaccatactcaccatctcctatttctacaagccctccaactttttctcctcctattgtaaactatccaccccactgtatgccctatcctcctaccacgcctattactacgcctccatttgcaccctatccaccttcaaatcccacagttccatacactcctaatcccccatcaactactccctactcaccttatcctcccagcacaccatctacaccgtcaagtcaatccctctggtgtgtagcaaaacctactgtgccaaattcagtcttgcagcaggctatgaactatgcatgtggagcgggtgctgactgtaaatctatccagccaaacggactatgcttttcacctgacacaatggttgcacatgcttcttttgctttcaacagctattggcaaaagaataaaggtattggtgggacctgtgatttcggagggactgccatgctgattacaatggacccaagttatgaaggttgccactttggtttaatctaaggaataaacatcgagttattctccaatatagcaattaaggtcaaaatcatcacaatcttcgtgtaaaacagaatctacagatttgcagttcagttttggggatgttctgtcgagggaatcagtgcatgccaactggttttgttcatagcagtagtcataacaaagtgttgttactgctctgcaatatctggttattttgtaggggtatttcacaggctcttaggttggaattcgaatcacttgtgtgtgacttttatatcttcactcttgcacacaagaattgttcagtgtattatatcttagagttctgtgactaagattttcatcattaatgtgtattttgttactcttcaatatgttttgtctccagtaaaattgtaacctggtcagaaagcggcaactgtaatttctataatagttgtttatcttaaaaaaaaaa

SEQ ID NO: 22 - DNA, 1183 bp, Pinus radiata
ttgccagggagaaatatggcagcgtctaatgaacagatgaagagaatcgtgattgggttgattgccgtcttctgttgtgcaatcgtcactgatggtgataaaataggagtgaactacgggatgcaaggagacaacctgccacctgcagaccaggtggtaactttgctgaacggccacaacatcgggaaaatgaagcttttcaatccagacggtggtgcattgaatgcttttgcaaattctgggatcgatgtaatcgtaggagtcagtaacaacgatttgcaggccatctcctccagccaggactcagcaaatggttgggttaatgacaatattgtgcgctattccagcaccagtatcaaatatattgcggtgggcaacgaggttttgcctagcacgcagtacgtatcgtatcttgttccagccatgaacaacattcaaaccgcgatccagaacgccaatctgcagaacatcaaggtctctaccccccatgccttcaatgttataggcgtcagttccccgccttcacatggagcattcagcgacgatgtgaaggataccatgagctctatactcaaatttctttcagataacggggctccgttcatggccaatgtgtatccatatttcagttacgccggcgacaccaccgacattcatctggactacgctctctttcagcccacggctacgccggtgacagacggagatcacagctacaaaaacttgttcgatgccatggtggattctattttctccgcaatggaagccttgggatattccaacgtcccgctcattgttactgaaagcggatggccttctgctggcgcggatgcggccacaactgagaatgctcaggcttataacaacaatctcatccaacatgttttatcgaattcagggacacccaagaggccgggtacgaacatcgagacctatatcttcgctcttttcaacgaagaccagaaaactggggacgagatagagcgtcacttcgggctcttcaaccctgatcaaagtcctgcatactctgtcaacttttctccttaactatttttatgcaaaatgcaatgatataaatctatagaggatgctacataaataaacatcctccctcgttcttaataaaatgtgaatggcaaagtgccgaagccgtcacagagttacctaaaaaaaaaaaaaaaaa

SEQ ID NO: 23 - DNA, 1258 bp, Pinus radiata
aagtctctcatttcttgtgagaaatatggcagcgtctaacgaacagatgaagagaatcctgattgggtttattgccatcttctgttgttcaatcgtcactgatggtgataaaataggagtgaactacggcatgctcggagacaatctgccacctgcagaccaggtggtaactttgctgaacggcaacaacatcgggaaagtgaagcttttcgatccagacggtggtgcactgaatgcttttgcaaattctgggatcgatgtaatcgtgggagtcagtaatagcgatttgcaggccatctcctctagccaggactcagcaaatggttgggttaatgacaatattgtcccctattccagcaccagtatcaaatatattgcggtgggcaacgaggttttgcctagcacgcagtacgtatcgtatcttgttcctgccatgaacaacattcaaaccgcgatccagaacgccaatctacagaacatcaaggtctctaccccccatgccttcagtgttataggcaacagttacccgccttcaaagggagcattcagtgacgatgtgaaggataccatcagctccatactcaaatttctgtcagataacggtgctccgttcatggtcaatgtgtatccatattttagttacgtcggcgacagcaacgacattcatctggactacgctctctttcagcccacggctacggcggtgacagaccaagatcacagctacagcaatttgttcgatgcgatggtggattctgttttctccgcaatggaagccttgggatattccaacatcccgctcatcgttactgaaagcggatggccttctgccggcgcggatgcggccacaactgagaatgctcaggcctataacaacaatctcatccaacatgttttatcgaatgcagggacacccaagaggccgggtacgaacatcgagacctatatcttcgctcttttcaacgaagaccagaaaactggggacgagatagagcgtcacttcgggctcttcaaccctgatcaaagtcctgcatactctgtcaacttttatccaaattgagcgcaactgatcaattctccgaaataccaagtcgaaggaaaaaatccttaattatttgtatgcaaaatgctatgatataaatccatagaggatgctacataaataaacatcctccttgcttcttaataaaatgtgaatggcaaagtgccgaagccgtcacagagttagatatcttgtttattgaaggaccgcactaaa

SEQ ID NO: 24 - DNA, 1264 bp, Pinus radiata
agaaaaatggcagccatgaagatcacgctgattgggtgtattgcaatcttgtgttcaattctcgcggacgctgctcaaataggagtcaacaacggcatggtcggaaacaatttgccacatgcagacgaggtagtaaccttgctgaaggagcacaacattggaaaatataggattttccaagggagcccaggcgtactgaaagcttttgagaattccgggatcgaggtaatcgtgggaatcgaaaccaacagattgcagcaaatatcgtctagccaagaggcagcaaacggttgggttaaggacaacattgtgccgttctatcccgccaccaatataaaatacattgcagtgggcaacgaggtttttaagagcaacgagaacgttcagtatcttgttcctgccatgaagaacattcaaaccgcgcttaacatggccaatctgcagaataagatcaaggtatccaccacccacgcctcagaatctgtgataggcaactcctacccaccttctaagggagcattcacagacgaggtgaaggacaccatgaggtctgtgctgcaatttctgtcagataacgaggctcctttcatggctaacgtctatccatttttcagctacgtcaacaactggaaaaacattaagctggattacgctctttttcagtccaagtctccggtggtagagagctacaccaacttgttcgatgccattgttgatactattatctccgccatggaaaatttgggatatgacaacatcccactcatcgttactgaaagcggatggccttcgggtggcaacattaatgtggccaccattgagtatgctcggacttataacaacaatctcatccgccatgtattatcgaatgcagggacgcccaagaggccgggaaggagcatcgagacctatatcttcgcccttttcaacgaggacaagccaagtcaagatgacacagaacgtcactatgggctcttctaccctaataaatcgccggtatatgcggtcaacttttctccgtgattgacatgcgaggaaaacactcgcaccacgtcaataaagtcgatgtcgacaaaccatagtcatctgcatgcaaaatgcagtgatttatgttatggaggatgctacttatacaatcgtcctcctaaataaattctaataaagtttggaagctttcatttgaataatctggctggaaatggaaggccttcccatatagtttttaaagtaaatattttaaaggtttgacagtctaaaaaaaaaa

SEQ ID NO: 25 - DNA, 1949 bp, Pinus radiata
atttaaaaaagatgataaagatgatacaaatgtcagggttttgaactctagccccccatttaaaaaaagatgatgaagatgatacagatgtcaggcttttgaactctgatatggctggatgtgtcggttctgacacgcacatttttaatatatataaaagaaaaaaagcccgtaatccttctaaaaggaactagcccctcccatttaaaaaaaatgatgaagatgatgcagatgtcagggttttgaactctgacaaggtcgcggtaaagcagaaagaaggtgatctctctccaccaagtcccggccaggcccctgaggctggtctaattcgatgataagggcaagtttagaatggaccctgaggccgtcgccactctgcagcccgtgatagggcctctcagtgttgtttccgtctgcggcttggcatgacgcgtcaaagaaagagtctcattttaaatcagactggatcaagggagccctctgtgcagtgtttcgtcaagcgagatagggctacatctacctatcaattgtttctgagtctcactacaaacttgatcaagggagccctctgtacagtgtttcatcaagtgagctagggctacatctacctatcaattgtttctcagtctgactacaagaatatggcagcctccaaagaacaagcgaagataatcctggtagggtttattgccatcttctggggttcaatcctcactgatggtgataaaataggaataaattacggcatacagggaagcgatctgccaccggcagacgaggccgtaagtttaatgaagaagaacaacatcgggaaggctaggattttcaaagcacagaaggatgcgttgaaagctcttgcggattcggggatcgatgtaatcgtgggtgtggctactgaagatttgcagggcatatcctctagccagcactcggcagacgcttgggttaatgacaacattgtcgcgttctatcccgccaccaatataaaatatattgcagtgggcaacctcatcttgtgtagcccgcagtacatatcatatcttcttcctgctatgaccaacattcaaattgcgcttcagaatgccaatctgcagaatagcatcaaggtctctactacacacaacatgagtgttatagctggcatcgacttcccggtgtccaatggtgccaacggcgacaatgtgaaggacaccacgagatctctcctcaatttcctgatagctcacaactccgctccttctcagggaaccttcagtgacgacgtaaaggacagcatgaggtctattctcgaattcctgtcatatcacggatctccttacatggccaatgtctatccatacttcatctttaccggcggcagcagcggttccatgtctttggactacgctctgtttaagcccacgtccccgttagtagacggagttaggaggtacaccaacttgttcgatgccatggttgatactattatctctgccatggaaaacttgggatatccagacgtcccgctcatcgttactgaaagcggatggccttctttcggggaggatgtggccacagttgagaatgctcagacttataacaacaatctcatcaaacatgtattatctaatgcagggacgcccaagaggccgggaacgagcatcgagacatatatcttcgctcttttcagagagaacctgaagtcggggcctacaacggagcatgactttggactcttcaaccgggatcaaacgcctgcatatacagtcaacttttctccattattataaatttgtgatgtattttgatttcaagtgggtaatatacaaatagtattttttgtactatgtctccaaatttacattttcctggtatcagagcttacatagacctgactccctcaacggagaacccaaagaatgagtgaatcgtaaatatttaatctactgtattacatacgaaaaaaaaaa

SEQ ID NO: 26 - DNA, 1534 bp, Pinus radiata
gaacatcttctgtgcaaaatatttttcaaatctgtaatttaccgtcagatctatgggataatccattaattttcttatacatgaacaaacatcttctgcacaaaatatttttcaaatctgtaatttcccatcagaaatatggcagcctccacagagcaagcgaagataatcctggtagggtttattgccatcttctggggttcaatcctcaccgatggtgataaaataggagtaaattacggcatacagggaagcaatctgccacctgcagacgaggcggtaagtttaatgaagaagaacaacatcgggaagtgtaggattttgaaggcaaacagggatgaattgaaagctttggcgaattcggggatcgatgtaatcgtgggtgtgggtactgaagaattgcaggccatatcctctagccaggactcagcagacgcttgggttaatgacaacattgtcgcgttctatcccgccaccaatataaaatatattgcagtgggcaacctcatcttgtgtagcccacagtacatatcatatcttcttcctgctatgactaacattcaaactgcgcttcagaatgccaatctgcagaatagcatcaaggtctctactacacacaacatgagtgttatagctggcatcgacttcccggtgtccaatggtgccaacggcgacaatgtgaagggcaccacgagatctctcctcaatttcctgatagctcacaactccgctcattctcagggaaccttcagtgacgacgtaaaggacagcatgaggtctattctcgaattcctgtcatatcacggatctccttacatggccaatgtctatccatacttcatatttaccggcagcagcggctccatctctttggactacgctctgtttaagcccacgtccccgttggtagacggagttaggaggtacaccaacttgttcgatgccatggttgatactattatctctgccatggaaaacttgggatatccagacgtcccgctcatcgttactgaaagcggatggccttctttcggggaggatgtggccacagttgagaatgctcagacttataacaacaatctcatcaaacatgtattatcaaatgaagggacgcccaagaggccgggaacgagcatcgagacttatatcttcgctcttttcagggagaacctgaagtcggggcctacaacggagcaggactttggactcttcaaccgagatcaaacgccggcctatacactcaacttttctccataattgagctgctgcatctagaaaatgtacatttttattttaaaattacagaaaatatatgttagtttttaagtttaatatatatattatagagatatatatattggtgagatattaatcttatttttagttagttttctgatgtcagttaggtgtcatcacgattgattttgttgtgtattaattgttataggtagttcatttttactttgagttgtatttcataagttttgagttaattcagtaatttattattgatgtttataatgtaaaaaaaaaa

SEQ ID NO: 27 - DNA, 1903 bp, Pinus radiata
cgactttgaagtgccattgggccctttttagctgttgggcgctctcaatccatccccaaatcctttcttaggatcccttatcccattttttttgtcactcaaaatccatctgtgagctgttttaggcctccgatccgaggaagcaacggtccaggaaccgtagaaagctttaaaacgagctctgaaacgcctctgggtgctcggatataggattttattcagcaggaagagaagaaacgatggagcgtcagtggtttgctatcttgattatttgtgcattagggagcatggtctgtgcagtggaagggctgggggtgaattggggcaccatggcattgcatcagttgcctcctgatatcgtagtccagatgctgaaagacaatggaataaagaaggtgaagctatttgatgcggattcgaacactctccaggctttggcaaatactgacattgaggtcatggtggctattcccaacaatatgttgcagcgcttcagcgacagttataaggctgcagagaaatgggtggacaagaatgtcaccagatataacttctctggtggtgttaacatcaaatatgttgcagttggaaatgagccttttctgtcagcatataatggctcatatctgaataatacatttcctgctctgcaaaatattcataaagctcttgtcaaagcaggtttagcagaccaaataaaagttactgtacctctcaatgcagatgtttacaattccccaactgacaatgcagtaccatctgctggggattttagagcagatattcatgacctcatgagcgaaattgtgacatttttgaatgataatggatcaccctttacagttaatatctatccctttctaagcttatatgctgatgaaaacttccccacagattttgcctactttgatggtgatagtcagccactagttgatgggaatatccagtacaccaatgtctttgatgcaaatcttgatacattagtttggtctctaaagaaggcaggggtccctaatatgacaatcattgtgggagaagtaggttggcccacagatggtgataagcatgccactgctgcagctgctcagcggttcaatcagggcctgttgaagcatataactagtaaccaaggaacacccatgcggcctggaaatattgaagcttatctatttggccttctcgatgaggatgctaagagtgttgcacctggtaactttgaaaggcattggggcatttttgggtacgatggtcagccaaaatatgagctggatctttcaggtccattgcagaatggagggttagttcctgccaagaatgtccagtatttacctccaaagtggtgtgtgttcaagacaaatgctacagaccagtccaagatacttgacagcatcaagtatgcttgtacatattcagactgcactgccatgggttatgggtcgtcatgtaacaacttggatttgtatggcaacgcatcctatgcgttcaacatgtactttcaagtgatgaatcaatatgaaattaactgcgattttactgggctggcaatgataacagagcaaaatgcatcacagggaacttgcaaatttccaatagggattgcatatggtgcagcagagaggtccatcaagattcattctattctggctgctgtcctcttgggtgttgttacatttatcctgtcattcttataggaatttgggtccgtcaattcattctttttatatgcaaatccttctctttcctcccttcctcccctttgacttagcctacaaagatatgcattaattttttgtaaccacatactcaaactattgcaataaagcgatagaaccataccattatgtatttgattcttaacattttatacgagaaagtaagtcatgttattgctgcaaaaaaaaaa

SEQ ID NO: 28 - DNA, 863 bp, Pinus radiata
ggagcgttgaatgatatagaaagctagagcgagagcggtatacagtgcgtagtgtggtgaatatacattgagtatatatcataacccgcggaaaggaaccaagctagtctggtagtaaattagagaatggcaacgagtgcaatggcggttgctctccacgccctcgttcttctactgctttttggaatctctttttgctcaggtcctgggaagcagaagctatatagcagtagcaggggaaacgacaccaacctggcagctgaggaagctagttttttcttaggcaatgattcatctacaacaactccttcgactcccgtaaccgcgggcaccacctggtgcgtggctaagaacaatgtggatgacaacacgttgcaggtagcactggactacgcttgtggcctcggaggcgcggattgcactccaatacaacaaggtggagtgtgctttgaccccgataatgtgcaggcccatgcttcctacgccttcaacaactattatgttaagaatgggatgctgccaggcagttgtgactttggcgggagtgcagctccgactacccttaatccaagttatggcaagtgcactttcgagacaagtactggaacctcctccattacatcatcaccgggcagttcaataacaggagcgatgggacccagcacattcaacccgaacggcgctgcattcatggctccgtctcttgtcatatcatccattataacaatattatatttctctgccactctgtaatgtgtgggtttattaaatgagagtcctcatctgaatgcatcaaatggtgtaatattcttagtaggtatagctttacccttgtgtttgttttttaatgcatacaactgctt

SEQ ID NO: 29 - DNA, 1599 bp, Pinus radiata
agttgttatcaacttcaccgctgcaacgtgttcaaatttttgcaacttgttacaacttttagagtattatgtcttttgttggaagggatgagttgatcagaattggatagctgagcagaggagttagattactgacatttcatagcatggagatcatagtaagagtgtctgcaattacgatattgcttccactcttcatacattgcatacgatgcggagaaagcataggcagaagcaggactttggtggaacattcgccagctctgggtgtgaactatggacagatggcagacaatcttccttccccatctggagtagcgaagctagttcagagtacaactatttcaaagctgagaatatatggagcagatcctgcaattcttcaagcctttgctaacacaggaattgggttacttgtaggtattagtaatgaccaaatcccatctctgaaccagctggctgtagcacagaattgggttaagagcaacattgttccttttgttcctgccactgatatcattgggatctcagtggggaatgaggttctgttcagtggagatagggttctgatttctcagctccttcctgcattgcagaacctacacactgcccttgttgaggtttcacttgatcagcaaattaaggtctctacacctcattctatggccatactttctgcatctgcacccccatctgctggacgtttcagtgggagttttgacatgaaagccctggttgacttcctgcagaagacaggagcccctttcatgatcaacccatacccttactttgcttataagagtgatcccacagatcgaactctggcttatgcactctttgagcccaaccaagggtcttatgacaccaatactggcctcaaatataccaacatgtttgatgctcagcttgatgcagtgtactcggccatgaaatatctgggttacacagatattgatatagtggtggcagaaacgggatggccatctgcaggggatccttcagagacaggcgctagcttgcagaatgcaattgcttacaatggtaatctgatcaagcatgtgacctccatggcaggtacccctatgatgcctaatcggtccattgagatttatatttttggtctcttcaacgaggacctgaagccaggaccaacctcggagcgcaattttgggctctttaaaactgatatgaccatggcttatgatgtgggcttgttacgatctcagagtgcaagtccgtctcctgctgctccacgcactggtggtcctgttgtagctcctcctacagcgaaagtttggtgcattgccaagcccggtgttgatgaaaaatctttgaaacaaaatttggactacgcttgtgggcagggcattgactgtaagcctattcaacaagggggtccttgctacttaccaaatacaatggcatcccatgctgcttatgccatgaatgcatactatcaatctgcaggccggaacagtttgaactgtgattttgcgcagactggaactgttacttccaaagatccaagttatgggggctgcgtgtactccacagtcaactcttaacggatgagacatcgtagttttatatttagtggac

SEQ ID NO: 30 - DNA, 1096 bp, Pinus radiata
attcgcttcacttgatctacttatatcactcttaagccatgcatttcactactgctgcgttggtttccgctctggctgccactcctgttgtctacggtcaacttgactcaaaatttaaagccaagggcaagaagtactttggtacttgctccgattccggcctcctgtctgtctcgcaaaacgctaatatcatcaagtcggacttcggcgcattgactcccgagaacagtgcgaaatgggattccattgagccttcgcgcaacggcttcaactttggtggcttcgacaccctcgttaacttcgctcagagcaatggaaagctcgtccgcgggcatacctttgtgtggcactctcaacttccgtcctgggtatccagcatcggagatgcggcgactttgaccactgtcatccaaaaccatatcacgactattgctactcgctacaagggaaagatttatgggtgggacgtcgtgaacgagatcttcaacgaggacggttcgctccgtagctccatcttctctcaacgtctcggcgaaaactttgtttccatcgcattcaaggctgcgcgtgctgcggacagcaacgctaagctctacatcaacgactacaaccttgattcggtgaactccaaggtcaacgggctcgtggccctggttaaccgccaaaagtccgccggcaccccgatcgacgggattggttctcagacccatctttctgcgggaggctcgggtggcgttcaagctgctattcaaaagcttgccactactggatgtgatgtggctattaccgagctcgatattgccagtgccccaacctctgactacgtcgcggtcgtcaaggcgtgcttgaacactcccaaatgcgtcggcatcacggtgtggggcatctccgacaaggattcttggcgcaccggtgccaacccgcttttgttcgactcgaactaccagaagaaggccgcttacaactcgatcatttctgccctcgcttagttgcgcgcaacagagtgcacgtatttggaaatcaatgcctctgcacagaacgttgtatcatagttttagttgataaaattcttcttttgctcaaaccaaaaaaaaaa

SEQ ID NO: 31 - DNA, 3386 bp, Pinus radiata
actgatgcgtcaacgccaaggtttgggaaaatcttagtagtatcgaacacgtctcttaatctcgggaacaagtaatccatgaaatttaatgctggatcttgaaatagctttaaagtctaaaatgactgtcagattctggaaaatcagcgccagagcttgagacgttctgtgtttcttcgacataattcgagtggggattatttacttgggaattatggaaaaacagtaataaagttgtgtatttattctgtgatttcttggaggtcacatgggtggccaatttatggtatgttcagagaagtgtatagatggcaaattcgtatccttgttttgaattttcgtccaaagaagcgtgtgatttgtgaatcttgattgcttggcttaattgggaagtatcgtcgcttctttgtgatttgtggatcttgattgcttggcttaattgggaagtatcgccgaatacattaaagcacttacggtgaaagagacgatctctttgtttttcgcggcggaaatggatgtgggttcacaatgaagacgagtggtgggattcgcatgcagaaggagcccatgattttaatgtgacgggtgatctataaattgaagtgacatcttatcgatgaaggcccatcattcttgcttgggattttaacaagtgcaggaatacagataaagtcagagcgaaagtgttccgattctattcattagattcatggagaattttgtgcttgtactgttttgtattgggattggggtgttttttaacggggggtccttagttcaatccgccggatccttcccctgtgatcccagcactgggctcagctcgtttcctttctgcaatacctcgctgcccattggagacagagtgaaggatctcgttggacgtcttactttgcaggagaaagtggagcagttggtcgatcagaccaccgccattcccaggcttggaattcctgtgtatctatggtggtctgaggctttgcatggcgtgtccaatgtaggtcatggaacaaagtttggaggctcaattcctggggctaccagttttccacaagttatactcacggctgcttccttcaatacttctctatggaaagagatcggccaggtcgtatcgacggaggcgcgggctatgtataatgccggacaagcggggctcacgttctggagtcccaacgtgaatattttccgtgacccgcgatggggaagaggacaggaaacccccggcgaggacccccttgtcgccagcctgtatgccaccaactacgtccaaggtctacaagaaaccaacggtgctgacaccaaccgtttgaaagtagctgcctgctgtaagcattacacggcgtatgacgtggacaactggaacgggtttcagcggtacacgttcgatgccatcgtgtcgcaacaagatctggaggacacgtatgacgttccattcaaaagctgtgtattgaatggcaacgtggccagcgtaatgtgctcttataataaggtgaacggcgttcctacctgcgctgataagaatctgctggcgggcactatcagaggaaattggagcttgaacgggtacattgtctcagattgtgactccgtttctgtatactataaccaacagcactatggggcaactcctgaagacgcagctgccgatgctataaacgcaggattggatctggactgcgggagcttccttggtcagcacacagaggcagctgtgaatgagagcaaagtgacagagtctgcggttgatcaagccctcattaataccttcacagtactgatgcgcctcggccggttcgacggtgatccggctcagcaaccatatgggaacttgggaccgaatgacgtctgcactaatgagaatcagcagttagccctggaagctgccagggaagggatagtactgctaaagaatgatggctcactgccactggctgctaagaacatcagctccttggctgtcattggccccaatgcaaatgtcaccaaaacaatgatagggaactatgctggcatcccctgtaagtacacaacaccctttcaaggcctttcagcttacactcaaacactctacgcccctgggtgtgcaaatgttgcctgcatttcgaacgatagtttaattgctgaggcggtccagacagccagcagtgccgatgcaacagtgttaatagtaggtggagacttgtcactggaggcagagtctttagaccgaacaagtttgttgttacctgggcagcaacagcagctggtaacccaagttgcagatgcatccaagggacctgtaattcttgtgattatgtcagggggaccttttgatatttcatttgctaagaatagtgacaagatttcaggtattctctgggtgggctatccgggacaagctggaggagctgccattgcagatgtgatatttggagaatacaatccaggtggtagattgcctgtgacttggtatccagaggagttttctatcaatgttaacatgaccaacatgaccatgagggcggatcctgccacaggttaccctggcaggacttacagattctatactggacaaactgtctttgaattcggatatggaatgagctacacaagttttaacatcactgttgtccatgcccccgaactcatctctgttcctctggatgaaaaatacacatgttctcccacacaatcagaatcttgcgagactatcagcttgaccaacactaaatgcgacaacatgtccctgcaagttgatgttgatgtgaataacattggtaacagagatggcagccatgtattgtttctgttctctacagccccatccaataatgtcgatgccccaaataagcaactgattgatttcaaaaaggtctatgtcgaagcaggtgccacagaaagggtcattttcactcctgatgtgtgcaaggacctcagcattgttgataagactgggaccaggatgttgccagtgggttctcggcttctttacattggtgatctggaacactctgtttctctgcagataagcagctgattcccactctagtgaaatttggctgtctgcttccacaaggagcagggcagctctgctaatgattccttttccaagtgagaataattattgattttgattcttgctataatttttttcattgattgtatttcctgctacaaaattgcattaacaatccctggcagaagctatgttagattcctgtagtaccatgctattcatgcaagattgttcttttgctgggaggctttgtatttaaacaaattaacctctccagaactcaatatactgtttgtttattattagtttggttctccgaaggcaattgtcaggaggcagattaaggttaggtaataaacattgacttttgaatgcattatcaccggag

SEQ ID NO: 32 - DNA, 2829 bp, Pinus radiata
gggattagcatgcagaagcagctcatgtttggttgcttggcatgcgcccgattatctctttatggtactgagatcgaatcccccacgcccccaatccaaaggtactattcaagaagacagcaagagcagggtagcctgtaaaatagaaaagccccccaggcccttctgctctgttaatgggactaatggagaatttggtctttgtatttgttttttgcattgtggtgtttttgaaagaggggtccttggctcaatcggtcggtaacttcccctgcagcgggcagagctcgtttcccttttgcagcacctcgctgcccattggggacagagtgaaggatctcgttggacgcctaactctgccagagaaagtgcagcagttggtaaatacggccagtgccattcccaggctggggattcctaagtatgaatggtggtctgaggctttgcatggggtgtccaacttaggtcccggaactcgtttcggaggatcagttcctggagctaccagttttcctcaagtcattggaacagctgcttccttcaatacttctctgtggcaagccattggtcaggtggtatccacagaggcacgggccatgtataacgcagggctggcagggctgacgtactggagtcccaacgtgaacatattccgtgacccgaggtggggtcgagggcaggagacccccggtgaagacccggtcctggccagcaagtatgccagcaattacgttcgcggtctacaggataccgacggcggggatccgaataggttgaaggtggcagcctgctgtaagcattacacggcgtatgacgtggacaattggagtggggtccagcgttacacgttcaatgccatcgttacgcagcaggatctggaggacacgtacaatccgcctttccagagctgtgtcgcggatggcaacgtggcaagcgtgatgtgctcctacaataaggtgaacggcatccccacctgcgccgataagaatctgctcgccgggaccatcagaggcaaatggaacctgaacgggtacattgtctcagactgtgactccgttaaagtattatttgaaagtcaacattatacgcccacccctgaagatgctgcagcagatgctatactggctggattggatctgaactgtggggactttcttggtctgcacacagaagcagcggtgaaagcaggcaagctgcccgagtctgctgttgatgcagctttggttaatatcttcacagtgctgatgcgccttggctggttcgacggggatccgaccaagcaaccatatgggaaccttggaccaaaggatgtgtgcacagccgagcatcagcagttggcgctggaggctgctaggcaggggatagtgctgctcaagaacgatggcccattgccattggctgccaacaaagtccactccttggccgttattggccccaatgcaaatgtcaccaaaacaatgatagggaactatgctggcattccgtgcaagtacaccaccccactccagggcctttcagcgtacactagaactctctacgccgctgggtgtgcagacgttttatgcagtggaaacaatttgttaggtgcggcggtccagacagcaggaaatgcagatgcaacagtgttgatagtaggtggagaccaaacattggagaaagagagcttagacagaatggatttgctgttacctggccagcaacagcagcttatatcccaagttgccgctgcatccaagggacctgtaattcttgtgatcatgtctgggggtccttttgatatatcctttgcaaaggataataacaagatctcaggtattctttgggtgggctatccgggacaagctggcggagcagccattgcagatgtgatatttggagcatataatccaggtgggagattgcctgtaacctggtacccgcaggattttgctgcgaaaattcccatgactaacatgaacatgaggccggatcctgccacaggttaccctggccggacttacagattctacactggaaaaactgtttacatgttcggtgatggcctgagctatacaaacttcaagcacacattagtccatgcgcccaagctgatctctcttcccatggatggaaaacacagctgttctcacaaatcgtcaaattcttgtgaggctatcagagtaacccacaccaaatgccaaaacttgttcctggaagtccatgttgaagtgagtaatgttggccgaagagagggtggccatgtcttgtttttattctcctcacccccatccaagcaccatgccccaaagaagcaattgctcggattcagaaagctccatctccaagcaggagccatggaaaaagtccatttcactcttaatgtatgcaaggatctcagcattgttgataagactggcaccaggaagttgccagtgggttctcatcttcttcatattggtgatgtccaacactctgtttctctacaaataagcagttgattcccactcaatggaaatctggctgtatgcttccccaaggagcagcggggcagctctgataatttttccctcataactggaataaattattgtttactgtgtccccttatcagaaattgttgtcaacaactgcaggcagaggcttttttatattgccagtagtactatagattcatgaagttctttttgctaagaggctctgaattgatcatattagcctctttggctcacaagtaaattgattgttcactattattgccgtccccaaagcaattgccattgtgcagattcagggtatgtaagaagctgattgcttttttaatgaaatattgttcatcatggaaaaaaaaaa

SEQ ID NO: 33 - DNA, 3170 bp, Pinus radiata
cctcgtgccgtccaatttggaaaaattacaatctctgaggacaatcaacacagagtcacttacgcgccaaatttccgaagaaagcggtgggaattgagacattttagccaaatttccgaagcaagcggtcggaattgagacattttagttaaaggcatggatctcacttaaaaatattgaagaataaagaggcggactgatcgatgttttctgcgtgatcaacccgttaaagtcttccatctgaaatgtgcttcatttgtcggaagataatagagagcgtccactttagtagggaccattgaacgttttagtgtgcagagttgcagtaaaagcaggggcacagttatcggaaaaacagaaacactaaatgcagcggaagagcgcagtgttgcagtaaaagcaggggcacagttatcgaaaaaacagaaacagtaaaggccgcggaagagctactgctaaaaagttgtgagtagccatttgaatgctgtatatgtgaagccaagtccattgcttgcagtcttaactgagcatcaaatttgatccttctttgttcatcagaggatgaagtcgttatggtggttggtaaatatagttatgatgatggtattaggagcgatagcagaggagcctccatttgcgtgcgatagcagaaatccagcgacacgatcttacgcgttctgtgattcttcaaaacccataacagtgcgcgtggaagatctaatatcgcggctgagcctggtggagaaagttgaacagctaacgaataacgcatcggccgtacaacgcctgggaatacccaaatacgaatggtggtcggaagctctacacggagtttcccagtggggtcgcggcattcacttcaatggtcccattcatacagctaccagttttcctcaagtcatactaacggctgcgtcctttgatgtcaaactctggtatcacattgcccaggcaattggcattgaagcgagagcgatatacaatgcagggcaggcgtcagggcttacattctggacgcccaatatcaatatattcagagatcctcgatggggccggggtcaagaaactccgggagaagatcccctgctatctagcaggtactctgttgcctacgttaggggattacagggcgatccgctttcttcctcttctaagacaaatgtccgctcttctactcatttgagagcttctgcttgctgcaagcatttcacagcttacgacatggataactgggagggccatactcgcttctctttcgatgctatggtgaccaaacaagacttgttggatacatatcaaccgccgttcaagagctgtgtggagctagggcgtgccagtggtatcatgtgctcttacaacagtgttaatggagtcccaacgtgtggtgatttcaaccttctcaccagcactgcgagacgtgactggggatttcaaggttacatcacagcagactgtgacgctgttgccactatttacacttctcatcggtatacaccgactgcagaagatgctgtagcggacgttctgaaagcaggaatggatgtcgactgtggaaattatttgggaaaatacacaatgtcagcaatagcgaaacgaaaagtgaacgaatcagatatcgacagagcccttcgcaatttgttctctgtgcgcatgcgtcttgggctttttgatggtgatctcaaccatcaactggagggaaaacttaaaatgcgggttgtgtgctctgctgaacatcaaagattggcattgcaagctgcaaggcagggtattgtgcttctcaagaacagcagaaaacatctgcccttgtcgaaaacacggaccaagtcattggctgtcattgggcctaatgccaacaatgcaactactctcctaggaaactactatggtcttccatgtcacaccataacaccgcttcaaggcctgcagagatatgttagggacactctgtattactccgggtgtgaggacctggcatgcatttctaacaatttgttcggggaagctgtagagattgcaaagaaagtggatgaagtggttgtagtcgttggcttagaccaaacccaagaaaaggaggaacgagaccgaataaaattgactctaccaggccaacaagagaaattagtgtatcaagtttcccatgctgccaaaagacctgtggtgcttgtcatcctctctggcgggccagtggatgtgtcgtttgcagtaaatgatcctcaaatctctagcattatttgggcaggctaccctggtcaggctggtggtcaggcacttgcagagattattttcggtgactacaatccaggtgggagattacctgtgacatggtaccctcaagacttcgtgaagataccaatgacggacatgaacatgcgtccaaatcatcatacaggctatccgggccgtacatacaggttttacacagggaagaaagtgtttgactttggtcaaggactcagttactcagcatactcatatgagttctcttccacaaccatcaagaagattgatctgaatgtgacaatggagcatgttgaaacccttggtgacacaggaaaagctcatgtcagagtggagaacagcccttgcaggaagttaaaattcagatgctccatacttgtgcggaaccatgataacatggatgggaggcatgcagtgttgttgtattccaagtcccctgcaacccacaaaggagccccacaaaagcagctaattggatttcgcagtgttcatgtcccgggtaaacagacaaccaacattacgtttgtggttaagccttgtgatcacttcagtactgttgaagagaatgggcaaagacttttggctattggttcccattccctaatagttggtgatacccagtattcagtttcacttgttaccaaacactcgaacagaaatccatagtacttagtaccagctataatgataatccggtttgcttcaggacaataatcgcattgtctttgatctctgggaagtaaaatcgcttcatgacaatattcgcattgtcatctgggaagtaaaataacagtggcgtttatggttttaacgactccatccgctgccattgttgtgattcctaaattgttatttgattacatgctttgtatttccatttctgtcattgtgaacccaagttattaagctttctatttctattaaaaaaaaaa

SEQ ID NO: 34 - DNA, 2642 bp, Pinus radiata
aacagtgcagcatcatgctaagtttcagagcctgaaacactctgaaatatttagcattgcagatccaatatctcatggggccacttgcaattgcaattgcagatctgttattatggatgttgtttctgtgttgtgggattcatggtcagcccatgtttccctgtgacagtaggattccaaatgctgcaaattatccattctgtaggacaactttgcccatcaaagatagagttaatgacctcattgggcgcctcacactgaaggagaaggctcagcacttggtgagcaggtcaggtgcagtttcgaggctcggaatcccagtctatgaatggtggtcagaagccttacatggggtctcaaatgttggccccggaactcactttgatcctcgctctgttcctgctgctactagttttccccaagttattctcactgcagcttcattcaataccgccctctgggaagttataggacaggcggtatcaacagaagctcgtgcaatgtataatgcaggattagctggtttaacatattggagccctaatgtgaatatatttcgtgaccccagatggggacgaggtcaagaaactccaggagaggatcctttgctttctagtaaatatgcaacctactacgtaagaggattacagtcaccagatggtagaaatcctaacagattgaaggtcgctgcttgctgcaaacattacactgcttatgatttggataactggaatggtgtagatcgcttccatttcgatgccaaggtttcacaacaggacctggaggacacatataacccaccgtttaagagctgtgtgattgacggtcatgttgcaagtgtcatgtgttcttacaacaaaattaatggagttccatcatgtgcagacccaaagcttctcaatggggttatcaggggagaatggggattgaatgggtacattgcatcagactgtgattctgtagatgttttgtacaacactcagcactggacttcaactcctgagagagcagtagctgatgtcataaacgctgggttggacatcgactgtggaaccttccttggggatcatgcagaagcagcagtgagagttgggaagctgagggaatccttaatagacgaggctttatcccattctttgactgttcaaatgcgcttgggattatttgatggcaatccagcaatgcagcactatggtaatcttggacctcgggacatttgtactaaccaacatcagcaactggcactggaggctgcaagacaggggatagttttgctgaaaaataacaatagagtattgccattatcagccaccagaatcagatccttggctgtcattggacccaatgcagatgccaccaatgccatgattggcaattatgcaggtataccatgcagatattcaacacctctacatgctctaggtaaatacacagcaactatatataaaccaggctgtgaaaatgtagcctgcaatagaaatcttccgctcattcacgcagctgcacaggcagcatctcgagccgatgccactgtgataattgtaggagcagaccaatcaatagaagcagaagcgcttgacagagtgaatctcttgttgcccggagagcaacaacaaatggtaatagaaacagcagctttctcaagaggaccagtgatacttgtagtgatgtcagggggaccaatggacatttcatttgccaaatataacagcaagatatccagcattctgtgggtgggatatccaggagaagctggaggagatgcattggctgatataatctatggccatcacaatccaggtgggagattgcctgtaacatggtatccacaagatttcgttgcaaaagcacccatgacaaacatgaacatgcgccctgatcgcgcaactggttacccaggacgaacttacagattttacacagggagaacagtttacccatttggctatggattgagctacacaacgttctcccatactctggtcaatgcaccagagctggtttcattgtccctccatgacagcccacttatgccatacaatggaacaaacaattcctgcacttctgtccatgtggagaacactaagtgccagggattgctctttgatattcatatggatgtgcataacacaggcaacagagatggtgggcatgctgttcttttgttcttcagtcctcctacaattcacaggtctcctcagaagagtctcatggacttcagaaaggttcatgttggggcgggagccaccgaaagagtgcaatttagcattgacgtgtgcaaagatctgagtattgtggatgagattggtgtcaagaaattggcattgggttcacatattctccatgtgggagatgtccagcattccctcaatcttcaaattgaatgaatggagaacagtttgaaacagattggtaattattgatccaactacttcaaaatatttgaagttgcagtaggaataaaacttttaggaaagtttaggaatgtcaagctggttgtatatcattattttttggatcaagttccataatttgtcttagtttagaaacagaggcaggcagaaccaagaggttaaccttgccccaaattagcattgtcaattcataaatattattttaaattattttatttaaaaaaaaaa

SEQ ID NO: 35 - DNA, 2784 bp, Pinus radiata
atggccatggataattatcacccaaataatgcctcctaattatttattcagcatttacacgtctacctcatctatccattagtactgctcatttctgccacaaaatctataaatggtggctgccaccttcaacattcaatccaattctctgttctgtcacagagtttgaattgctattctcaaatacaatttcattagagatcagatttctttgatatggggccgaaagcaatttccaatattgcaggtctgatattatggatgctgtttttgtgttgtgggattcatggtcagcccaattttccttgtgacagtaggattcccaatgctgcaagttatccattctgtaagacttccttgcccatcagagccagagttagtgacctcattgggcgtctgacattgaaggagaaagttcaacagttggtgagcaagtcagccggagttcccaggttgggaattccaagctatgaatggtggtcagaagccttacatggggtctccaatattggcccaggaactcaatttgcagctgggtctgttcctgcagctacaagttttccccaagtcattctcactgcagcttcattcaatacctccctctgggaagccataggacaggctgtatcaacagaagctcgtgcaatgtataatgcaggattggcaggattgacatactggagccctaatgtgaatatatttcgtgaccccagatggggccgaggtcaagaaactccaggagaggatcctttagttgttggtagatatggcacctattatgtaagaggattacagtcaacaggtggtaaaaatcgtaacagattgaaggttgctgcttgctgcaaacattacactgcttatgatttggataactggaatggttttgatcgcttccatttcgatgccaaggttacacaacaggaccttgaggacacttataacccaccatttaagagctgtgttatggatggccatgttgcaagtgtcatgtgttcttacaacaaagtcaatggagttccaacctgtgcagacccaaagcttctcaatggaattataaggggacaatggaaattgaatggatatatagcatctgactgtgattcagcagatgttttgtacaatacccagcactggactacaactcctgaaagagcagtagcagatgtcttgggggctggattggatgtcaactgtggaaccttccttggggatcatgcagaagcagcagtgaaggttgggaaggtgaaggaagccttaataaacagggctctaatcaactctttcaccgttcgaatgcgtttgggagtatttgatggcaatccagcaacgcagccctttggtaatcttggacctcgtgatgtttgtagtgagcagcatcagcaactggcgttggaggctgcaagggaggggatagttctgttaaaaaacaataatagagtattgccattattcaaaaccagaacaagaaccttggctgtcattggacccaatgcagatgtcaccaacgtcatgattggcaactatgcaggtataccatgtagatacacaacaccccgacaaggtctgggtaaatatgcaacaactatatataagcctggctgtcaaaatgtggcctgccaaagaaatcctacgctcatacacgatgcttcacaggcagcatctcaagcagatgccacagtaataattgtaggagcagaccaatctgtagaaagagaagggcttgacagagggagcctgttattgcctgggcaacaagaacaaatggtgttagaagtaacagctgcatcaagaggaccagtgatacttgtagtgatgtcagggggaccaatggacatttcatttgccagagatagcaacaagatatcgagtattctgtgggtgggatatccaggtcaagccggaggagatgcgttggctgacataatctttggtcatcacaatccagggggtagattgcctgtaacatggtacccacaagattttgtaacaagagtacccatgacaaacatgaacatgcgtcctgatcgtgcaactggctacccaggccgaacttacagattttacacagggaaagcagtttacccatttggctatggattgagctacacaactttctctcattctctggtccatgcaccagagatggtttccttgtccctccatgaaaaccagcttctgtcatgccatggaacgaacaattcctgcaattctgtcaacgtggagaacaccaaatgcgagggattgctccttgatgttcatctggatgtgcagaacacgggcagcagagatggagggcatgctgtgctcttgttttccagcccccctgcagttcatggggctccacagaagaacatggtgggattcagaaaggtccatgttggtgcaggaaccacagaaagagtgcatttcagcattgatgtttgcaaagatctgagtattgcagatgagagtggtgccaagaaattgctactgggttctcatcttcttcatgctggagatgtgcagcattcccttaatcttcaaattgaatgacaggagattaaggctttaaatatcaatttatttaagattagagtgatgctaacagctacaacttgtaaaagctcctggttgttgctgttgggtaataatagtttgggtaatggtcgtttattactgggaagccaatgtaattgtagataccgtggtgcgttctggtggagtcacttcaaatatgaaagtttgtaaaatggcaacatagacttttcgatcaatatgaacaagttttcaactctaaaaaaaaaa

SEQ ID NO: 36 - DNA, 2649 bp, Pinus radiata
aactttaggtgaggcatcttctctcgagtcagaggtgagaaactagagcagtggacagccaagtctggagcaattccttcaatgagagaagagggggtaatcgacatttctggatgagattacttacagtcatgtcaagacagatacaagcgctgtgcatatctatagtactcagtctgagcattgtgattgtgatttctgattcaactgattacgcttgcaaggaacatgatgtaaatagtgtatcatacggattctgcaacacgtcgctgcctataaaggagcgcgttgaagatctgataaggcgtatgactctagaagaaaaggttggacagctgtcgaatggagcatccgatgtgcagaggctgggaatacccagatacgaatggtggtcagaatcattgcacggtattgcaactaatggaccaggcgtcaacttcgatggtcccattaccgcagcaactgttttcccccaaatcatcctctccgcagcttccttcaattccactttgtggtttcgcacagcacaggcaatagcagttgaagctcgagcaatgtacaatgttggacaagcaggcttgacattctgggcacccaatataaatatctttcgagatcctcgctggggaagaggtcaggaaaccccaggggaagacccattattgactagtgagtttgcagttgcatttgtaaggggttttcaaggcgaaaatgagagtcatgacacaatggagaagagtcagagaagcagagctaggagggagttaaaaatggaggggctaaatagcctccaaacagaaccgagtcgcttgatgctttcagcatgttgcaaacatttcacagcatatgatttggatagttggcaaggtcacgctcgctacaccttcaatgctgtggtgtctgaacaagacctgaaagatacattccaaccacctttccagagatgtgtgcaagatggtcatgctagttgtatgatgtgctcatacaatcagctaaatggagtccctgtatgtgcaaactatgaccttctcacacaaatgacaagaaatgactggggccttgaagggtatattacttcagactgtgatgcagtagcaatcatttctgaagatcagcactatgctacatgtgcagaagacgcagtcacagacgttctgaaagcagggatggatatcaactgtggtacttatttgcttcgaaacacaatgtcagcaattaaacaaggaaagctccatgaatcagtgattgatcaatcccttttcaatttattctcaattcggatgcgccttgggctttttgatggtgatcctaaacaacaggaatatggtcatcttggaccagaccatgtctgtactaatgaacactggcaactagcattagaaggctccagacagggaattgtgcttctcaagaacattggcaatgctttaccagtgtcgaaaaataaaatcaactctatagctgttataggacctaatgcaaatgctacggaagaaatgcttggcgattatataggcatcccttgcaatcctgttactccatttgtagcccttcagaattatattggcaatgtatcattctccaaagggtgtgaaaatgtggcctgctcttccaatgccaaattcggtgaagcagtagatattgcagctaaagcagatgctgtagttattgttgtggggttggatctcacacaggaaacggaagatcatgacagagtaaatttaaccctcccagggcaacaacagagactagtatctgaagttgctgttgcttcaaagggacctgtggtacttgttctcatgtgtgggggtccagtggatgtttcatttgcaaaggatgatcctcgaatttcaagtatattgtgggtgggttatcctggtgaagctggaggccaagcactagctgaaattatttttggagattacaatccaggtggcaggctacctatgacatggtatcctcaaaaattcatcaatgtacctatgacagacatgaatatgcgacctaattcttcaacaggctatccaggccgaacataccggttttacactggagaaacagtcttccaatttggcgaaggtttgagttattcaaactactcatacaaattttcctcgaaggatgggcatattattctgccattttcttcaccatcgtacggagagtgggtatctgactacattgatatagatgatataccatgtgaaagttttaaatttaccactaaacttactgtacaaaaccatggtagcatggatgggagccatgttgtactgttattttcaagatatggtggaaatttcagaggagctccacacgagcaactaattgactttaaacgtgtccatatcgttgctggtaaaaccactgatgtgagctttcttgttaatccttgcaagcactttggtatggtgatggaggatgggagaagggtcttagccattggaaatcatgaactgatggttggagatactcgactttctgtttccttgaaaacaagcttcttgagtagaaaatgacattattttgttcagcctttgctcactgttgtttcaaaaaatgttggcatttcaaagatatttttactgtttatccaagtgtaattgattcattctctatttttagtattttatcctaacaaaaaaaaaa

SEQ ID NO: 37 - DNA, 2871 bp, Pinus radiata
aactataagacccatgtgagtgtcagagaagtccctgaacatcatggtgccatggacaattatcaccgacaccgtctaattatatattcagtgtatacaagcctacctcataagtttagtaaatctataaatttatgaatggtggctaccgccatcaacattctcaaagaacgcaggtttcttctgagtctgagagtttgaaagactctcagatattatttcatgggggctagtgcagttccaattgcaggtctaatattgtggatattgttttttcgttgtgggattcatggcgagctcatgtttgcttgtgacagtaggattcccaatgctgccaattacccgttctgtagcactgccctgcctatcaaagacagagttaatgatctcattgggcgtcttacattagaggagaagattcaacagttggtgagcaaggcagctggagttcccaggctgggaattccaggctatgattggtggtcagaagccttgcacggggtttcaaatgttggccctggaactcagtttgcagctgggtctgttcctgctgctacaagttttccccaagtcattcttactgcagcttcattcaatatatccctctgggacgccataggacaggcggtatcaacagaggctcgtgcaatgtataatacaggattggcaggattgacatattggagccctaatgtgaatatatttcgtgatcctagatggggacgaggtcaagagactccaggagaggatcctttactggttagtcaatatgccgccaactatgtgaggggattacagttaacagatagtctggatactaacagattaaaggtcgctgcctgctgcaaacattacactgcctatgatttggataactggaatggtgctgatcgctttcattttgatgcccaggttacacaacaggacctggaggacacttataacccaccgtttaagaactgcgtgattgatggtcaggctgcaagtgttatgtgttcttacaacaaagttaatggagttccaacctgtgcagacccaaagcttctcaatggagttattagaggagaatggggattgaatggatacatagtatcagactgtgattcagcagaagttatgtacaacacccagcactggacttcgacccctgagagagcagtggcagatatcatggagtctggattggatgtcaactgtggaaatttccttgcggatcatggggaagcagcagtgaaggttgggaagctgaaggaaacctttatagacacagctctattcaactctttcactgttcagatgcgcctgggattatttgatggcaatccagcattccagccctatggtaatcttggacctggggatgtttgtagtgaacaacatcagcagctggccttagaggctgcaaggcagggaatagttctgttaaaaaacaataatggagcattgccattatccccaacccaaatcagatcattggctgtcgttggacctaatgcagatgtcaccaatgtcatgattggcaactatgcaggtataccatgcagatacacaacacctctacaaggtttaggtaaatacacagcaactatacataagcttggctgtgaaaatgtagcctgccaaagcaattctatactattaagtgaagcttccgaggcagctactcaagcagatgccacagtgataatcgtaggagcagaccaaacagtagaagcagagatgcttgacagagtgagcctgtcattgcccggacaacaagaacaactagtattagacacagcagatgcagcaagaggaacagtgatattagtagtaatgtcaggggggccaatggacatttcgtttgccagagataatccgaagatatgcggcattctgtgggtgggatatccgggccaagctggaggagatgcattggctgacatactttttggccagcacaatccaggtgggagattgcctgtaacatggtatccggaagaatttgcaataaaagtacccatgacaaacatgaacatgcgtcctgatcctgcaactggttaccccggccgaacttacagattttatacagggaattcagtgtacccatttggctatggactgagttacacaacattctctcattctctggtgcgcgcaccaaagttggtttcgttgtcccttcatgaaagcctacttaagtcatgccgtggaatgaacaattcctgcgcttcggtcgaagtggagaacaccaagtgccagggattgctctttgatcttcatgcggaagtgcataacacaggtagcagagatggagatcatgttctgctcctgtttgccagtcctcctgctattcagggaattccacagaagcgtctgatgggcttcagaaaagtccatgttggtgcaggaggcacagaaagagtgcatttcagcattgatgtgtgcaaagatatgagtattgtggatgggaacggtgtgaagcaattgcttttgggttctcaccttcttcatgttggtgataccaagcatacccttcgtgttgaaattgaatgaatatgtctcgaaaagagtaagatcctgagtggattgtctgacatcagagatcagagtgaaattattgagcaacgactcctaaaaattgggtgtggttgctgtcgtgtagtgtaataatttggaagctggtgcagggttgggctagtggaagttggtagagctccattgttgcctctgctgggaagtctgcaaagagttttgacatcactctaattggaaaaaatttagtgttggctctaagtggaaacatgcaggagtttcagttcccatctaattgaaaaaaaccgttgggtggttcttttaaacaaaactattggtttcggtttaaaaaaaaaa

SEQ ID NO: 38 - DNA, 2450 bp, Pinus radiata
ggcattcttgggtgatgtgatgtcaaggacgatccggacagccacggcagagcaactgttggaggttgtgcctcctctttaaagatcattggctccaggtaagaagacagatcttcatagttgagcatggagaagtttcccttcctacagtcgcctactcaaaatgaaacagagccatattgtcacgcatacagctgctcagctcggtacaaatgctgcattaatatcagtacgaccatttttgccaatcgaatccttaatacccacatgcgttttgtgcctcatttcatcatccttccagtcttttacttgattggaagactatacgttcgctcacttagaatagacccacacataacttctcatgggtcatatttgtagttgcaaatggcaatttttgattctgctctgctttgtcttctttccatttgctgctcctacagaagggaggaggttggcccagactcccaaggttagaggtgtgaatctgggtggatggctagttgtggaaggatggataaagccttctctgtttgatgacatcaaggacaacgatcttcttgacggaacaaaggttcagttcaaatcggcgaaattgaacacgtacgtgagtgcagagaatgggggtgggcagaatgctgttgttaatagggacaatgcttctacctgggagactttcaagatgtggagagtctcagatggcatgtatcaacttagagtgtttagtggtcaattcctaacagcagaaaatggaggaggaggcaacatgtctgcagaagcagattctcctgctgattgggaaacattccacataattaggcaccataaacatcctaaccgagtgcatatcagggtgttcaatggaatgtatatgcaggcacaatcccaggagcagcttacagcagattaccaaggggatcctgggtggcatgacaattcagcaaccttccagatgattatagttgccaatgatttgcatggagattaccagcttgcaaatggatatggccgtgataaagcaaagaaagtttaccatagacatagaagcagctttattacagataaggatttcaaattcctctccaggaatggtataaatactgttagaattcctgttgggtggtggattgcatatgatccgaatccaccagcacctttcgtaggaggatctttacagtctctcgataatgcttttaaatgggcagatcattatggtttacaggttattgttgacctccatgcagcacctggttcacaaaatggaatggagcatagtgccagcagagatggatctgctgactggtctaactcttcagaccatatttcccaaagtttaactgttattgatttccttgcttcgagatatagtaacaatagtatgctcttaggtattgaattgctgaatgaacctctagcaacaactgttcctgtggatgttttggcttcctattattcaaatggctatcaaactgtgcggaaatactctgccacaacatatgttatcatgtgccagaggattggaaatgctgatccacatgagctgtatcaaataaatgatgcattttcaaatatcgttgtcgatgttcactactataatctttttgatgattattttgataacaagactgcccaagataatattgacttcatctcgaagaacagggaaccccaagtggaagctctaaacagcacaaatggtcctctcatatttgtcggtgaatggacaaatgagtggaaggtgcaaggagcttcaaggtcggaatatcaacagtttggtgatgcacaattacaagcttatgaaaaagcttcatttggttggtcatattggactctaaagaacgaagagaagcactgggattttgagtggaatatcaagcacaactaccttagattaggtaattcgagggcaacatcaaacaagagtatatcttggagaatatatgcctttttgttgatctttgggtgtatttatgtatgagacttgagcagtagggaaatctgacattttaatgctgctcaaaaatagttggtggttctttctgaaatagatttgacatatatgatgggacaattcctacattttaatccactgaagggcaacagtcaaatggattggtgcttgaagtgattccatgattcaattcttgctctttttccagagcctagaattatatcaacctcctgaagtgtggaataaacttataagttatgacagaggacatcaccaggtttaaacagaatctaagcaatttaaagagaattaacatgtgagatggtacagagtccatactgtagacctccgcagaaatggcagattttatataagcaactgcaaaggtggcaaaaccttgtaataagaaatgacctgaaagggtcgtaaatgtacattaaatactgttaactgcattcaattcaaggaattgacgtcggattcattcttaaaaaaaaaa

SEQ ID NO: 39 - DNA, 2001 bp, Pinus radiata
attggcagagtggagttgaaggatcctttgtcgatggtaagcaggatgaattcaggatggtatgtgtttctctgtgttgtgattttatgcaagtgtgcaggagccattgggtatgctaggtacaaggacccatctcagcccattgatgctcgtgttaaggacttgttgtcacggatgactctggaagagaagattggacaaatgacccagattgaaagaacagatgcgactgcagatgttatgaaacattactacattgggagtgtactgagtggaggagggagcgtgcctgcacctaaggcatctccggctacatggatcaacatggtggatgagctccagaagggtgccatgtccactcgtcttcagattcctatgatatatggcattgatgctgtgcatggtcacaataatgtgtatggggctaccatcttccctcataatattgggcttggagctaccagggatcctgatctggctagaagaataggggctgctacggctttggaagttcgagctactggcattcaatacacatttgctccatgtgttgctgtttgcagagatcctcgatggggccgctgctatgagagctacagtgaggatccaaaaattgtcaaggccatgactgagattatcgttggcctgcaagggaatcctcctgctaattctacaaaaggggggccttttatagctggacagtcaaatgttgcagcttgtgctaagcattttgtgggtgatggtggaacaaccaaaggtatcgatgagaataacactgttatcaactatcaaggattattcaacatccacatgaccccctattttgatgccatcgccaaaggagtctccaccattatggtttcttattccagttggaatggacagaagatgcatgctaaccattttctcgtttctcaggttctaaagaagcaacttggcttcaagggttttgttatttcagattggcaaggtattgacagaataactagcccacctgatgctaattactctttgtcagttttagatggtgtgggcgcaggaattgacatggttatggttcctgacaatttcacggactttattagcgatctgacttcacaagtcaagggtggtttcatttccatgagcagaataaatgatgcagttcaaagaattttaagagtaaaattcaccatgggactctttgaacatcctatggctgatccaagcctagccaaccaacttggcagcaaggagcacagggagttggcaagggaagctgttaggaaatctctggtgttgttgaagaatggaaagtcagccagcaagcctttgcttcctctagataaaaatgctcccaagattcttgttgcagggactcatcctgacaatctgggttatcagtgtggtggatggacaatagaatggcaaggattaagtggaaactcaaccataggaactacaattcttgaagcaatcaaatttgctgttagcccctctactgacgtggtttatcagcaaaatccagatgcaaattacgtgaaaggacaagggttttcatatgctattgtggttgtaggtgaggcaccttatgcagaaatgaagggggataactttaatttgacaattcccttaggtggaggtgacacgattaagaacgtctgtggctccttaaaatgtcttgtaatattgatatctggaaggcctcttgttatcgaaccttaccttccgttggtggatgcttttgttgcggcatggcttcctggcactgagggccaaggtgtgacagatgtgattttcggagatcatggatttcaagggaagctgccaagaacatggttcaagagtgttgatcaactgcctatgaacgtgggggacaaacactatgatcccttgtttcccttggggtttggattgacctgaatgtgggctacaagcaccatgatcccctgtttcccttggattttgaattgaccacaacagtagctgaaaatctaagggagtaaaaaaaaaaaaaaaaaa

SEQ ID NO: 40 - DNA, 2454 bp, Pinus radiata
ggtattctcgtccttttcaaaaccattcggatgtgaggggccgattttttccatatatttatcgttcattcttccttcctatattatcccaacaaacccactgcgcctcagttcaactgggcggagtctagtggactctttagctctcatctgattggcgagcagaatggattcaatctggtgtttgtttctgtttcttgtggctttcggcaaatgtgcagacgccgcccagtatactctgtacaaggacccatctcaacccgtctctgctcgcgtggacgacttgttggcacggatgtctctggaagagaagatcggacagatgacccagactgaaagatcagttgccactccagatgttatgacaaattactatattgggagtgtgctgagcggaggaggcagtgcgcctgcacctcaagcatctccggccacatggatgaatatggtagatggtctccagaagggtgccatggccactaggcttcaaattcctatgatatatgggattgatgctgttcatggtcacaacaatgtctatggggctaccatcttccctcacaatgttgggcttggagctaccagggatcccgatctggttaaaagaattggagctgccacagctctggaaattcgatctactggcattcaatacacatttgctccatgtgttgctgtttgcagagatcctcgatgggggcgctgctatgagagctacagcgaggatccaacaatagtcaaggccatgacagagattatctatggtctgcaagggcagcctcctgctaattctacaaagggggtgccgtatgtagctggacagtcaaatgttgcagcttgtgctaagcactttgtgggcgatggtggaacaacccagggtgtcgatgagagtaacactgtcactgattataaacaattagtcaacatccacatgaccccctattttgatgccattgccaaaggagtctccaccattatggtttcttattccagttggaatggacacaagatgcacgctaatcgttttctcatttctcatgttctaaagaagcaacttagcttcaagggctttgttatttcagattggcaaggtattgacagaataactagcccaccgaatgcgaattattctttgtcagtccttgaaagtgtgggtgcagggattgacatggtgatggttcccttcaattttgctgactttattaacgacctgacttcgcaagttaagggtggtttcatacctatgagtagaataaatgatgcagttcaaagaattttgacagtaaaattcaccatgggactctttgaacatcctatgggcgatccaagcttagccaaccaacttggcagcaaagagcacagggacttggcaagagaagctgttaggaaatctttggtattgttgaaaaatggaaagtctgccagccagcctttgcttcctttgaataagaatgctcccaagattcttgttgcagggactcatcctgacaatataggttatcaatgtggtggatggacgatagaatggcaaggtttaagtggaaacataaccataggaacaacaattctctcagcaatccaatctgctgttagctcctctaccgaggttgtttatcagcaaaatccagatgcaaactatgtcaaagaacaagggttttcatatgctattgtggttgtgggtgagccaccttatacagaaatgtttggggataatctcaatttgaccattcctttaggcggaggtgatacgattaacaatgtctgtggctccctgaaatgccttgtaatattgatatctggaaggccacttgttatcgaaccttaccttccactggtggatgcttttgttgcggcatggcttcctggcacagagggccaaggtgtgacggatgtgatttttggagattatagttctcaagggaagctgtcaagaacatggtttaaaagtgctgatcaactgcccatgaatgctggggaccagcactacgatcctcagtttcccttgggttttggactgaccacaacagtagcagaaaatataagctcttcatttggtgttctatagaaggaggtccctagcgtgcttgccatgattattatcctgtgcttgcacatgtatactctgtaaaactctctaaaacagatacagctcaaattcattatagttttcagttttactttaaggcattccttatcatcagcatgaggatcaaaaagatattgtactctgatatgacacaaggtaagaatgaaggtcatagaaccaaaaattgtactttgaattgacatcagataagaatgaaagtcatagatgatagaaccaattgtttgtaaaacagtagaataatcttgtactttatatctggaaaaacagatatacatctgtttgccttgtccttacatatttcttctaatgctgatgatgtcattcatgttaaaaaaaaaaaaaaaaaa

SEQ ID NO: 41 - DNA, 2052 bp, Pinus radiata
ggatcagagtggagagggtggggtttattgatggcgaacagaatggattcagggtggtgtttgttgctgtttgttgtggttttatgcagatgtgcagaagccgttgaatatgctaagtacaaggactcatctcagcccatcgatgctcgtgtggacgacttgctggctcggatgactttggaagagaagataggacaaatgacacagattgaaagaacagtggccacagcagatgttatgaaaaattactacattgggagtgtacttagcggaggagggagcgagcctgcacctcaggcatctccggctacatggatcaacatggtggacgggctccagaagagtgccctgtctactcgtctgcagatacctatgatatatggcattgatgctgtgcatggccacaacaatgtctatggggctaccatcttccctcataatattgggcttggagctaccagagatcctgatttggttagaagaattggagctgccacagctctggaagttagagctactggcattccatacacatttgctccatgtgttgctgtttgcagagatccccgatgggggcgctgctatgagagctatagcgaggatccaacagttgtcaagtccatgacacagattatcttgggtctgcaggggcagcctcctgccaaatataaaaggggaattccttttgtagctggagagtcaaatactgtagcttgtgctaagcactttgtgggtgatggtggaacaaccgatggtatcaatgagaataacactgttatcagttatgatggattagtaaatattcatatggccccctattttgatgccattgctaaaggggtctccacgattatgatttcctattccagttggaacggagtgaagatgcacgctaaccgttttctcgtttctcaagttctaaagaagcaacttggcttcaagggctttgttatttcagattggcaaggtatcgacagaataactagcccagctggtgctaattattctttgtcagtctttgatggtgtcagtgcagggattgacatggtgatggttccctacaatttcatggactttattggcgatctgacttcgcaagtcaagagtggtttgatctcaatgacgagaataaatgatgcagttcgaagaattctgagagtaaaattcaccatgggactctttgaacatcctatggcaaatccgagcctagccaaccaacttggcagcaaggcgcacagggagttagcaagagaagctgttaggaaatctctggtcttgttgaaaaatggaaagtcagacagcaagcctttggttcctttggataagaatgctaccaagattcttgttgcggggactcatcccgacaacctcggttatcagtgtggtggatggacaataacatggcaaggattaagtggaaacacaaccaaaggaactacaattctcgaagcaatccaatctgctgttagcccctccacagaggttgtttatcaggaaaatccagatgcgaattatgtcaaaggacaagggttttcatatgccattgtggttgtgggggaggcaccttatgcagaaacagctggggataatcttaatttgaccattcctttgggtggaggtgacacaattaataatgtatgtggctccgtgaaatgccttgtaatcttggtatctggaaggccgcttgttattacaccttatcttccattagttgaagcttttgttgcggcgtggcttcctggatctgagggccaaggtgtgacagatgtgattttcggagattatggcttccaagggaaactttcaagaacatggttcaaaagtgttgatcaactgcctatgaatgttggggacaagcactatgatcccctgtttcccttcggttttggattgaccacaacagtggctaaaaatctgtagttatttaggcttacccgtctcttatttatttaataatggtcgcactgtgtaacaaatttgatctaacaacaataattgaaaaagcattttgactctttttattaaaaagagctttttccagcaaaaaaaaaa

SEQ ID NO: 42 - DNA, 2645 bp, Pinus radiata
ggttccgagaaacaaatctcctttcagcttacctaagttacgtcgtattcaatgtctttttccaagtgaatatgccaataacaaacatattagtgcgccgttgtggagaaccctcgtttcgaatttaatgccttactaataacggttactagggttctcggccactgttatcctttcacactttcatccacttatcctccctgcgcctccctgcgcctcactgtgcctctgttcatctgggttacagggtttcatagtcataataatatcggatgctcgggttgtagtccccattgttgtcctcacctgcttgcaggcttgctctgcttatcctcacttcgcctttgttcatctgggcagagtggtctataaagatcttctttgtggagagcagaatggattcagggtggtatttgttgctgtttgttgtggttttgtgcaggtgtgcagaagccactgaatatgctaagtacaaggacccatctcagtccatcactgctcgtgtggatgacttgctggctcggatgactttggaagagaagatcggacagatgacacagattgaaagaacagtggccacagcagatgttatgaaaaattactacattgggagtgtactgagcggaggaggtagcgctcctgcacccaaggcatctccggccacatggatgaacatggtggatgagctccagaagggtgccatgtcgactcgtcttcagatccctatgatatatggcattgatgctgtgcatggccacaacaatgtctatggggctactatcttccctcacaatgtagggcttggagctaccagggatcctgatttggctagaagaataggagttgctacagctctggaagttcgagctactggcattcaatacgcatttgccccatgtattgctgtctgcagagatcctcgatgggggcgctgctacgaaagctacagcgaggatccaaaaattgtcaagacgatgacagagataatctttggcctccaggggcagcctcctgccaattccacgaaaggggtgcccttcctagctggacagtcaaatgttgcagcctgtgctaaacattttgtgggtgatggcggaacaaccgagggtatcaatgagaataatactgtaatcagttataaaggattggtgcacatccacatggcggcctattttgatgccattgccaaaggagtctccaccgttatggtttcctattctagttggaatggcgggaagatgcacgcgaaccgttttcttgtttctcgtgttcttaagaagcaacttggcttcaagggctttgttatttcagattggcaaggtattgacagaataactagcccagctggtgctaattactctttgtcagtttttgatggtgtgagtgcagggattgacatggtgatgattccctacaatttcaaagacttcattaacgatctgtcttcgcaagtgaagagtggtttgatccccatgactagaataaatgatgcagttagaagaatattgagagtaaaattcaccatggggctatttgagcatcctctgggcaatccgagcctagccaaccaacttggcagcaaggagcacagggagttggcgagagaagctgttaggaaatctttggtattgttgaaaaatgggaagtcagccaacaagcctttgctccctttggagaagaatgcttccaaggttcttgttgcaggaacccatcctgataatctgggttatcagtgtggtggatggacgatggaatggcaaggattaagtggaaacataaccgtaggaactacaattctggaagctatcaaactagctgtcagcccctctactgaagtggtttatgagcaaaatccagatgctaactatgtcaaaggacaagggttttcatatgccattgtggttgtgggtgaggcaccatacgcagaaacgtttggagacaatcttaatttgaccattcccctaggcggaggggacacgattaagacggtctgtggctccttgaaatgccttgtaatcttgatatctggaaggccacttgttattgaaccttatcttccattggtggatgcttttgttgctgcatggcttcctggcactgagggccaaggtgtgacagatgttatttttggagattatcgttttcaaggtaaactggcaagaacatggttcaagagtgttgatcagctgcctatgaacataggggaccagcactatgatcccctgtttcccttgggtttcggattggtctgaagatggggacaaccactatatgatttgtttcccttgggtttttgattgatctgaatgtcggggactagcactatgatcccctgtttcccttgagttttcgattgaccacaacagtagctgaaattccaagggagtaatttaggttcatctcttatttaaaagaatgaatgcattttctaccaaattatgccgggttgtgacagatgttacagggaagctgccaagaacatggttcaagagtgttgagcatatgaatgtatgggacaagcacactatgatcccctgtttcctttgggtttcgactgaccaccacagtagatgaaaatcaagagtaatttaggcttgcccatttcttatttaaatgaatgaatgaatgttgtagcaaaaaaaaaa

SEQ ID NO: 43 - DNA, 1836 bp, Pinus radiata
gcaaaatgctttagacatcgactcgatatcagcaactgcaatctattggcgagcagcgttcaaaaggacaacagttctatcgagttgaagatttcactatggcagcttgcatcaatatccatgcaagaaattgtcctcaaggatgctttaaatttgttattctggttttgatcacatcttgcttggcttatggaagcgaggcatcagaagtgaggaggcttaccataggcacacagaaataccactctgtagccctgggagggtggctcgttatcgaaggatggataaagccttcgctctttgatgggattccggataatgatctgctggatggaacgcagatccagttgaaatccatgaaactaggaacctacatcgttgcagaaaatggaggagggcagaaagtggccgtgaacagaacaaatcccttaaaatgggagactttcaggatatggcgtgtgagagatggctactaccaacttagagtcttcaataagcaatttctaggagccgataatggagggggtggtgttgtgaaggctgtggccaccacccctagaagctgggaaacatttcagatcatcagaaacaacgccgatcgaaatcgtgtgcatctcaaagccttaaacggaatgtacttgcaggccaattctaaagatcagttaactgccgatttcaaaggggagcctgcttgggacggcaataatgctgcaactttcgagatgagcttcacaggacatatgcagggggagttccaaatctcaaacggttatggacccgaaagagctgcccaagtcttgaaggaacatcgcagcactttcattagggaggatgatttcgttttcctgtccaaacaagggataagtgctgtcagaatcccagttggatggtggatagcaagtgatccaaaacctcctgctccttttgtcggaggatctctggaatgtctagataaagctttctcgtgggcacagaatcatggtataaaggttattatcgatctgcacgctgctccaggctcacaaaacggcgatgaacacggtggcggcagagacggatatatagaatgggctgattcacaaaagaacattgacaccactttatccaccattgattttcttgcttctagatatgctgcacatcctgcccttttgggcattgagctgctgaatgagccacggtcctctggaatcagtttgaacaatctgactgcctactatacacaaggctacaacatcgttcgaaagtattcctcctcggcctatgtgataatgtgcaacagaatcggccctgttgatccaaaagagttgtttcagatcaacaatgggttattccgcactgtagtagacgtgcattactacaatctcttcgatgattccactttcaaacatatgacggttcagcaaaatatcgactatattaaaaacacgagagctcaaactctccagagcctcgtctcggcaaatggtccgctcatctttgttggggaatgggtggccgagtgggaggtgcagaatgcgacacaatcagattatgaaaggtacggagatgcacagttccaagtatacgggacagcttccttcggatggacatactggactctaagaaatattggtaacaggcactgggattttcagtggatggtgaacaatcagtaccttcgattgccatcgatccagatttgatttttctgtgtaatacagccaatgaatacgtttcggtggggataataatcttgaatttttctaatgtttctgcgcgagcttagctcaataaatttggagtaatcttttttataccacctattaggtataaaaaagtttgataaaaaaaaaa

SEQ ID NO: 44 - DNA, 2173 bp, Pinus radiata
ggataatttagagtttcgcatttctgtgccttgtgacctggagaaaccctacctaattaaattcctaccatcactaacgtgtaacttaatgcactgagcctattggattctgcgacccattatatgagtatggctctctataaaatgtctcaactatcaacgtgatattaatgtgctcgatttgaagatttcagaatggcagcttacatcgacgtgcacgccaaaaaattgtctcaaagatgtttcggatttgttattactctcctggttttcacgtcttctctcgcttatggaaggaagatattagaagcgaggagacttaccaacgacacgcagaagtaccattctgtaaatttgggagggtggctcgttatcgaaggatggattaagccgtcactctttgatgggattcctgacaaggatctgctggatgggacgcagatccagttaaaatcgatgaaactgggaacctacgtggttgcagaagatggaggggggacaatcatggcagtaaacagaactaatccctccggatgggaaactttcagcttatggcgtgcgagagatggctactaccaatttagagtcttcaataagcagtttgtaggagccgataatggaggagggggtattgtggaggccgtagccaccacacctaatagctctgaaacatttcagattattagaaacccggccaattccaatagtgtgcatatcaaagtcttcaatggaatgtacatgcaggcacaatctaaagatcagctgactgccgatttcgaaggggagcctggttgggacgacaataatgctgcaactttcgagatgaccatcgtaaggacgttgcagggggagtttcaaatctcaaacggttatggacccgagaaagctacacaagtcttgaacgaacatcgaagcactttcatcacagaggatgatttcgttttcatgtccaagaacgggataagtgctgtcagaattccagttggatggtggattgctagtgatccatatcctcctgctccttttgttggaggatctctagcttgtctcgacaaagctttctcgtgggcacagaaccatgacattaaggtgattatcgatctccatgctgctccgggctcacaaaacggtgatgagcacagtggcaccagagatggatttatagaatggcctgagtcgcaagagaacatcgacaagagtctatctgtcattgattttcttgctgcgagatatgctgcacaccctgcccttttgggcattgaactattgaatgaaccacggtctcctgcagtaagtttgaacaatgtgactgattactattcacggggttacgacatagttcgaaagtattcgtcgtcggcgtatgtgataatgtgcaacagaatcggccctgctgatcccaaggagttgtttcaaatgaacaacggcttatcccgcacagttgtggatgtgcattattacaatctctacgatgacgccactttcaaaaatatgacggttcagcagaacatcgactacatcaaaaccacaagagctcaaactctgcagagcctcgtctcggccaatggtcctctcatttttgttggggaatgggtggatgagtgggaactgaacagtgcgacacagtcggattatcaaaggtacggagatgcacagttacaagtatacggtgaagcttctttcggctgggcatattggacgctaagaaacattggtagcaggcactgggatttggaatggatggtgcaaaatcagtaccttctattgcctgcatcaaaccaaagttaaatttttgcttccttggaagagatgaatcaatgataatttattattaaataagtaagtcgatgaataagtttcattggagaataagtagctgcaacagtagcttgagtgaaataatggtacaatccatagcccaaaccgtgggatgatgggtcatatatacccacccatgggtaattcatatgaaatttaatatcaagacctcgtaatattggagtgtaatcattattgttactgctaatgcccactttctgtaaaagatagaccacatcgcagattcctaagtgtgacccacaactcggacgcacttggtagatggatgatggtcgagcatgatatttgtggttcattttaattgctatgacgtttgcctaaaaaaaaaaaaaaa

SEQ ID NO: 45 - DNA, 1919 bp, Pinus radiata
catcagtggatgcgctcaggtctccaatataactgtactggatagattatatacatcaaagaccttcatacccgataaaatattctgtgttaggtgctgggaagtattcatgcaatgggatttattcacacaatggcaattccagaatcaaaagttttctggcttctgttggccatagtgggaggtgtaattcatgcctatgcagaggattacaccattggtatcgattatgggcagcttggcgacaacctgccctccacagaagaagcaattcacttgatccaaagaatgaaggtaggcagagttaaaatctatgatactaatccagaaatcctaaaggctctcgcgcacactggtattaaggtctcagtgatggttaagaacgaagttattgccaatgtctcggccaaccagtcatttgcagacaaatgggtgaagaataatgttgtttacttctatcctgcaaccaagatcaatatagtcctggtggggaatgaaattttatcagactactccaacaaccagacctggtaccagctagtgcccgctatgctgagaatcaggcgagctctggttagatataagctgcatcatatcaaggtaggaaccccttctgctatggatgtgctcaacacttcatttcctccatcatctggtgcttttcgggatgatgttgcagaaactgtcatgaaaccaatgctcgagtttctgactagaacgagatcctacttttttattgatgtgtatccttactttgcttggtcttctgatcctacgaatatttctttggaatatgccagttttggggatcatgataaaaactacaccgatcctaatggccttgtgtataccaatttgctggaccagcagcttgatgcggttgtagctgcgatgagcaaactgggttatgaggacattaggttaatcatagctgaaactgggtggcccaatgccggtgaccttaatcagttgggtgccaacatctttaattcagcccattataaccggcggctcataaggagaatgcttgcagatcctcccctgggaacccctcgcaggcccaatcaattcatccccacctatattttttcattgtttaatgaggatcaaaagtctggaccgggaactgagagacattggggtttgttgtatccaaatggaaccagggtttatgagattgatctcactggtgagctccaggattcggagtataagcctctccctcctccacctccaccctacactggcaaattgtggtgtgttgtagatgctaatgcaaatgtttcttccttgccgtctgctattaattatgcctgcagtcagggaaacaacacctgcgcttccattcagccagggaagccttgttatcagcctaacacggttattgatcatgcatcatatgccttcaacagttattggcagcaattcaagaactcagggggcacttgttactttaatggagctgcaacactagtcacacaggaccccagtcgtggaagttgcacatacccattcacttgactgatctgcagggaatgtggaagcagacgttttctctccatctgacctatttgcagaactgtctccagatgtctggctttgttgaatgcagtatttttgtcagttctagtcgttcagaagattacactactgattcaattcattgtagaagcactaaattttttatcttagaggaactggttacatagcatccttgtaattgatagcagggagtcctcatatatatagttatctatcagtttatagatcccatatttctagggatctctataactgttgttctatctgttactgcacctctttgcaatggtctaatgtatgataaatgcttttgagctttcaccatccatatgttgatatttaaggaagcagctctgtgtttcctggtaaaaaaaaaa

SEQ ID NO: 46 - DNA, 1546 bp, Pinus radiata
ccttaagaggttacgaattctttcttggtacacagactgtcgttgaaggttctggcgggtcatctatgtctgtggaagccgccttagatcctcctacattaaaatttctttcctcagatcacagtatttaaaaatcccgctcaacaatgagaaggcggatggggttgttgttctcggttctggtgatgtttgtgtgggtcggttgggtgcgagggctgggagtgaattggggtacgcaggcgtcgcatccattgccacctgacatactggtgggattgctgaaagacaatggtataaagaaggtgaaactgtttgatgcagaggagcgcgcgatgagagcgttggccaagtctgggattgaggtgatggcagggattcctaatgaccagttgcagagaatggccaacagtcaaaaagctgcggccaattgggttgaagccaatgctactgaattcagcttggatggtggcgtggatataaggtatgttgcagttggaaatgagcctttccttaaggcatacaatggtacttttatacagtatacttttccggctcttcaaaatatccagaatgcgctgaacaaagcagggttaaaaaatattaaggcaacagtacctcttaatgcagatgtgtatcagggagatacaccatcggagggacaattcaggccagatattaatgatctcatgatacagatttgtcagtttctggctagcaatggtgcaccttttacagttaatatctacccatttctaagtttgtacactaatgaaaactttcctgtggattttgccttttttgatggtactggccagccagtgatcgatggaaatatccaatatacaaatgtgtttgatgcggctcttgatacactcttttgggctttaaagagggcagggttccctgatttgcctgtccttgtgggagaagttggttggcctacagatggtgataaacatgcaaacatcaattttgcacagcgctttaatcagggccttttgaagcatataatgaatggtcgcggcacgccattgcgacctcaaaacattgaaacttatctatttagtcttgttgatgaagatgcaaaaagtatagcaccaggtaactttgaaaggcattggggcattttccagtacgatgggacacccaaatatgcacttgatctgtcagggcaaacacagaacacggcactggtttctgccaagggtgttaaatatttgcctagaagatggtgtgtgttcaatccgagtgcaagcccttcagtgttgactcagttacctgatagtattacctatgcttgtacacatggtgattgcacttctttgggatttggatcatcatgcaacagcttggattatcaaggcaatgcatcatatgcatttaactcatactatcaggtgaacaatcagcagaatggtgcttgtgggttttctagtttggccatcgtaactgagagtgacccatcacaagggacctgtaaatttgagatccaaatagcagttagtgcagcaagcaatactatgaacagttacctataaaaaaaaaa

SEQ ID NO: 47 - DNA, 1231 bp, Pinus radiata
tgcttgcccacaatccccatgtccagttgagaaaaatggcaactaacattattctgattgtttgtattgccatcttctgctgttcaatcctcgcagaaagtgctcaaataggagtgaactacggcatgttgggaaccagtctgccacctgcaggccaggtggtaactttgatgaagagcaataacatcgggaaaatgaagattttccaagcggacaaagatgctctgaaagcttttgccaattcggggatcgaggtaattgtgggagtcggcaacaacgaattgcagctcatctcctccagccaggacgccgcgaatggttgggttaatgacaacattcgccccttctatcccgccaccaatatcaagtatattgcagtaggcaacgaggttttgataaaaacgacgtacggatcgtatcttgttcctgccatgaggaatattcaaaccgcgctgcagaatgccaatctgcagaataacatcaaggtctcgaccactcactcctccgatgttagcgagggctacccgccgtctaacggtgtgttcaaagacgaggtcaaggacaccatgaagtctgtgcttcaattcctgttagatcacgggtctcccttcatgggcaacatctatccatacttcagctacatcaacaacagggctcagataactctggactacgctctgttcaagtccacgtctacagtggtgccagacaaaggtcggagttacaaatacttgttcgatgccttggtcgatactcttgtttcggccatggaagccttgggatatcccaacatcccactgatcgttactgaaagcggatggccttctgctgaggcggatgtggccacagttgacaatgctcgtacttataacaacaatctcatccgccatgtcttatcgaatgaagggacaccaaagaggccggggaagagcattgagacctatatcttcgctctctttaacgagaacaaaaagaaccccggaacggagcagcactttgggctcttctaccctaatcaacagcatgtataccctgttaatttttctccataattctgcagcttgtgagtccaacattcaaataaaaccgatgtggactggtcctcctctatatgcgaaatgccttgatacgtatattatctagtatgctacatatattgtaagctcttctacaataaaatgcggacaataaagtatcgtagccgttgaattatccctttttaaaaaaaaaa

SEQ ID NO: 48 - DNA, 1229 bp, Pinus radiata
gcggtgataaaaatggcaacctttaaagaccaatctaggatcttcctgattggatgtgtggccatcttctgttgttcagttctcgcagatggtgataaaataggagtggactatggcatgaccgcagacaatcttccatctccagacgaggtggtaactttgatgaagtccaacaacattgggaaaaccagaatttaccaggaaaacgatgttgtactgcaagctttcgcgaattctggtatcgatgtaatagtgggtgtcgctaacgaagaactgaagaacatatcttccagccaagactcggcaaaccgttgggttaacgagcacattgtgcccttctatcccgccaccaatgtcaaatacattgcagtgggaaacgaggttttgataaccttggataacgttcagtacgtaccctatcttgttccggccatgaacaacattcaaactgcgatccagaacgctaaactgcaggatagcatcaaggtctctaccacccacaggccggatgttagcagcggctacccgccgtctaaaggagtcttcgtagatgctgtgaaggacacgatgagccaaatactcaattttctgtcacagaacggtggtcccttcatggcggacgtctatccatacttcagctacatcggcaacacaaaagacatttctctggattatgctctgtttaagtctacgtctacggtggtgcaagacggtgatcacagctacaccaacctgttcgatgccatggttgatactcttttgtcggccatggaagcctcggggtatcccaacatcccgatcgtcattaccgaaagtggatggccttctgctggcgcggaagtggccaccattgagaatgctcagacctataacaataatcttattaaacatgtattatcgaatgcaggaacaccaaagaggccaggaatgagcatcgacacatatgttttcgcgcttttcaacgaggatttgaagccaggcgacgagacagagaaacactttggactattcgaccctaatactaaacagcctgtatactctgtcaacttctcaccatgagttgtgttggaatccacatcacatgtgacccgagtcgatgtagacaagcccttatctgcagacaagcccttatcttcatgcactgctatatgtaatctgcaagtgtatggttatttctaaaataaataaaatgtcaaagaagttgagtttaataaaaaaaaaaaaaaaaa

SEQ ID NO: 49 - DNA, 2047 bp, Pinus radiata
ggcaagatggagatgtatgatatgtgactttatgaaagctccgacttcatattttttcgatcagtcttttgtgttctctgtgtctgaaagattgtttaatgtgttttgattaaagctgaaccttctggagattgttcgagaagacccatgaagatcctcagcaggttcctgctgttgctgttgctgatcgcgtcgttcagcgaagtcgccctcggagggcccttcgttggagtgaatatcggcacagatgtgtcgaacatgccttcggcatcggctgtggtggccctgctgaagaatcagcagataacccatgtgcgcctctatgatgccgaccgccagatgctcacagcgctggccaataccggcatcgaagtggttgtgagtgttcccaataatcagctcctgggcgtcgggcaatcgcgatcgactgccgcgaattgggtgaacaagaacgtggcggcctacttgcccaacaccaacatcacggccattgccgtgggcagtgaagttctcacaacaatccccaacgctgccctcgtactggttcccgccatgaggttcttgcattcggccctggtggcggccaatcttgacgggcaggtcaaggtttcgactccccatcctgccgaactcatcctggattcattcccgccttcgcaggccttcttcaactcctcctggaacagcgtgatgataccgctgctggccttcctgcgcgacacaaagtcctacctgatgctcaacgtctacccctactacgtctacatgcagggcaacggtgtggtgccgctggactacgctctgttccgaccgctcccgcccaacaaggaggccgttgaccccaacacgttgctccactataccaacgtcttcgatgccgtggtcgacgcggcctactacgcgatggcctcgctgaacttcacaaacatccctgtggtcgtgacagagaccggttggccctccatgggcgacgccaacgagcccgacgccaccgtggacaacgccgatacttacaacagcaatcttgtccggcacgtgctcaacagcacaggaacccccaagctccccggcgtggctgtcaacaccttcatctacgagctcttcaatgaggacctcaggcctggtgggacttcggaggaaaactgggggctcttcagcgccaattctacgcccgtgtatgtccttcacctcaatggtgcgggatcgcctctgggcaacgacacttctgctcagaccttctgtgtagccctgtccggtgccgataatcaactcctccaggcggcgttggattgggcctgtggtcctgggcaggctgattgctctgctattcaggccggtcagagctgttatactcctgataccgttgcagaccacgcctcttatgcctttgacagctattaccacaagatgaacatggcccctgggtcctgtgacttcaacggagtcggcactataaccaatactgatccaagtcacggttcttgtattttccaaggcagtgttagtgcaaatgggacttcttctgtgaatggtactgtccttggcaatgagacatttcctttgacagggacaaatattacctctttaaatagttctgcaccccaccttcagtcacagattcatccaattctttttcctcttgttgcccttcccattctgttttggaatctgccaattttgtaggacaaaagcactatattattgatgtatcttttaagaacaagaaatgcttcattctttttttcaacaaagcaagatgtaaatggagaggctggatatagctttggagagaaataggctgtggaaatgaaagatttcatcagctgtcattttggggaggggaagctgaaaatgcaaattttgcaaagatcacaaattcattgttgtacgcagaatagaggtatcagagtttactgccattcattgataggtattctgtatatgtattataatatgtgtacaactatcactatcattgatactcatttattcgttagttgtatgtcctttattgactacaggtgagagacttgttataaaaaaaaaa

SEQ ID NO: 50 - DNA, 1924 bp, Pinus radiata
gtcggataacgcggaaaatggggtctctgaatcgctcgatggtttgttcgatgttgatatcagtttttttctgttttgtgtttggcgcgctgcatatggtctctgcagattttgcaaacaaacaggcactgggcatcaattatggacaggtagcaaacaatttgccatctccagccattgcagtccagttaatgaaaagcataaacgtgggttacgtgaagatatacgacgcagattctcaagtcctcacggccctcgcgaacacgagcctccctctggtgatcacagtggcgaacgaggacattccaaacatagcctccggctcctccaatgccgatcagtgggtgcagaagaacgttttgccgtactatcccgcgactcagattttcatgatcatggtaggaaacgaggtcctttccaacccccagatccagagcacctggtcacagctggttccagccatggagaacctgcaagcctcgctcgtgaaacacaatctcgacgactccatcaaggtaaccacttctgtggccatggacgcgctggcctcgtcttacccaccttccaatggctcgttcaaagccgacatcgccgcatctatcatgcagccgatgctcagcttcctgaaccggacggattcctattttttcgtggacgcgtacccgtactttgcctggagttcgaatcccgtcaacatttctctcaactacgtgctattcggcgtcagcactacagaaatactagacggccaattgcagtattccaacatgctggacgcgcagctggacgccgtggtggcggcaatggcggacctcggcttcccgcaggttaaattagcggtcagcgaaacaggctggccgaccaaaggagccgccgacgagcctggtgccaacgtcgccaacgctgccaagtataaccgcaggcttgtctccagattctcagcctcgcctcccgtgggaacgccgcggcgccccggggccttcattcctgtcttcgtcttcgctcttttcaacgaagaccagaaaaccggccccgtaacagagcgcaactggggcgttttctaccccaatgggacgcccgtttacaacatcgacctctccggtggcaaccagggctccgcctacactcctataattcgaagcgggacaaataacaatacattctccgctcctgctggcgcccctgcttccgctgctgcccccattcccaccgctgcccccattaccaccgctgctgcccccattcccaccgctgcccccattaccaccgctgcccccactccgtcgacgctgcagcagtggtgtgtggcgaaatcaggggtaaacaatatgaccgcggtgcagcaagcgctggactacgcatgcggtgcaggcgcagattgttccgctatccaagccggcaatgcatgttaccagccgaacactgtggaggcgcacgcgtcttacgccttcaatagctattggcagagtaccaaatccaacggtggcacctgctatttcaacggagtggccgctctaactacatccgatcccagcttccaaggatgttccttcccgtttcaatagaccacgactgttctctgctggattacaaacgttttcaaggcgaccagatatgcagggctgggcgttcatcgcataatcttattttcgattcttctgagaatatcattggatttgtcgtccttttgaatttaatttcacccgactggtttgtttctggaactatgtaacagctccaatttattctctacatatctgtgtaattataaagtgaaaatagtgactgagactctggatacggccttatccagagatcagaataagacctctctttctgatctcctgagatatcactatatgcttgaatgtagctgttgcgtttatataatttcatatttaattcttatttaacaaaaaaaaaa

SEQ ID NO: 51 - DNA, 1672 bp, Pinus radiata
gggtgacaaagtcattacggggggagctaatcatccttctgaatcgtgatggcggtccctagttaggcggagtcgttacgcatttgctttcccttctgaatcgtgatggcggtccctagttaggcggagtcgttacgcatttgctttcccttcttcagacacttcacagagttatcatgtttctctatatatagtgtagaaaggccctttcctctcacagtatcccataatctctaccattctgatttgacgccacaactatcatttttactacgccacgcttctgttatttggaagcaaatatacagccggccgagaaatggcatccagcaacaaagttggagtctgctatggaatggttgcaaacaatttgccacttccagatcaggtggcaaatctgataaggtctcgcaacatcggcaaagttaggcttttccaagcacatcacgaagcccagcgagcgttacaaaacagcggaggaatcgaggtgattgttggagttgggaacgatgagctccagaaaatcgcatccgatcaggctgcagcaaacgggtgggttaacgacaacattcgccaattctatccggccaccaacatcaaatacatcgctgttggcaacgaagttttttcaagtgaaaatcggcagcatcttccatatctcgttcctgccatgagaaacattcaaaccgcagtccagaacgccaatctgcagagctccataaaggtctccactacccacgccacgtctgttctgggaaactcgtatcccccttctcagggagaattcgctgatgaattgaagagtagcatgagcgatgtacttaactttctggcagagaatgggtctcctttcatggctaacgtgtatccctacttcagttacatttacaaccaggcccaaatctcgttagactatgctttgtttaaatccgcggatcccgtggtgagtgatgaaggtcgtctctataaaagcttgttcgatgcgctggtggattctctgatttccgctatggagaaatcgggacatcccgatattcccatcgtcataactgagagcgggtggccttccgcgggcaatgaggcggctactgttgagaatgcgcagacttacaacaacaatctgatcaaacatgtgctttcaaatgcaggaacgccaaagaggcctggacagcacattgatacatacattttcgctcttttcaacgagaatttgaaaggcggggacgagccagaacgacattttggacttttctatcctgatcaaaaccttgtttaccctgttaacttctccccttaaattcatctgatctgtgttttgcattagaatttccagtattacccattttctcacaataaagcgaaggcttgaaatcttggatttctttcgccaacttctccccttaaattgatctgtgttttccattagaattttcaatattatccattttgtcgcaatataacgaaggcctggaatctttgatttctctcgccttctaccaatgtaacgccatgcatagattggaattggaacctgtgttctagtgtcaatttcgcttctgccaatgtaacgccatgcattcactataccaatgtgataaggacgtcactatactgctgtaatctgtattctgaaaatgctaaattaagatcactcaaaaaaaaaaaaaaaaaa

SEQ ID NO: 52 - DNA, 2417 bp, Pinus radiata
gattgatggcctctcgcgtgatgagaaggttagaaaagtgaggggatcatggaaaacacgggattcgtgtaacattttatatatatacaaacgcttcgcttctccctgtttaagattctctgtagtgtagtggcttatcgtagctttggcgtggcgtagcagagtcccataaaagttcagacgacataatgtacccacacacccgatgcccactgtagaaaggagtcccgactcccaactcccatcgcgggtaaatggatggcagttccagagtatgcaattttatgtattatagactcacaattcctcgcccaacataccagatcaagtcactatgaggagcacagtatgaaatgtcatcgaatatacttgtaattctagtgagtaagagggataggtttggggattccgagtaatgtaaattatatatgttggatgaatgaatcggccctatgattcggagtaccgagcagcaaggaaggggggaatgcggagcaggagatagacatttggagcaaaagtgaacgattgcctaaataaagaagaatcatgtgggtgctcccgctgctgctgctactcctgttcctcttctgtccattcattttgggcgctcgcgttaatggaggggctttcgtcggtgtgaacatagccacagatttgtcaaacatgccatctccaagccaagttgtgtccctgttgcagacccagcaaataaaacatgtccggctttacgatgtggagagggatatgctcctagccctggcaaacaccagtattcaagtggttattagtatacccaacaaccaggtattagccatcggcgagtccaattccagtgctgctaattgggtgaaaaaaaatgttgcagattaccttcccaacacaaatattacagggattgttgtgggcaatgaggttcttactactcttcccaatgctgcgcttgttcttgtgtccgccatgaagttcctgcagtctgcattggttgctgctaatcttgatcagcaagtgaagatttcaagctctcattcttcagacatcattctggacgcattccctccttcccaggcaatctttaatcagagctttaatgatattattgggccaatgcttgagttcctccaagacactggttcatatttcatgatgaatctgtacccctactataccttcatggaaggcaaagggaaagtgccactggattatgcattgtttgaaccgctcacccctgacaaggaagcagttgatcctaatactttgttgcattacaccaatgttttcgatgcgctagtggatgctgcatactattccatgggtaatctcaactacacaaacattcctgtggtggtagctgagacaggatggccctcagatggtgatgccactgaaccttatgccaccataaacaatgctgacacttacaacagcaatctagtgattcacgtactcaatattacaggaactcccaagcgtcctactataccagtgaacacatacatatacgaattatacaatgaagaccttagaccaggtcctctttcagagcagaactgggggctattttttgctaatagcagccctgtttatgtgctacacttaactgacgcaggagaatttcttgcaaatgatactacaaaccagactttctgtatagcaaagcccggggctgatctgaagcttctacaggctgcactagactgggcttgtggaccaggggaagcaaactgtactgcaattcaagggggtgaagactgttttaatcctgatactgttgaagctcattcctcatatgcatttgatagttattatcacaacaccggaatggcagctgggtcctgtgacttcaagggtgttgctatcataacgacaactgatcctagtcatggatcatgtgtttatccaggaagtggtggtgccaatcaaacttctgccagtaagaacaacacctctgttagcggatctatggatatgggccacatggacaacagtgtgctgatgatgctccacattctcctccttttcctttggttttgagctttcaagtacttcagtttttatagcaaaagaaatcctacgatgtaacgttaggaaatctttcaaacggtatgtaacagatggataaaattagtgtttgtgatccattaatggtgttgtgcccattattactggagaaacttccagggatgtcagatagtttcttgctgtgctcatcatgaaaaagaggagagattttttcgggggtcattgcaaatttattctaattaactggaaaccatttttttccaaggtcctgccattgtgctgaacagcaggtaccaaagacctgtcatagtgctgaccagcaggcaggctggtgtaaggaagtacattcattattttactttttatatattattttattcatctgaaaaaaaaaa

SEQ ID NO: 53 - DNA, 2060 bp, Pinus radiata
gattcattggtctgaattacggtgaaggagagccgcggaattcgtccacgccttagtgggcgttataagtttcagatctcggcctccatttctttgcactaggtgcccagattgaagggttcaatatttccctgaaaaaactgcaaaattgggtgcttttttggcagaaattctgtgccataaagcagatcttttagcgtaaaatctgccaatcggtaactgtttctgctcagcactgaattggagttcgtgggctacgtgggattttctgttttaggaggtcagaacagctaggagaagtaacaggacaccatgaaggccctcatattggtcggtggtttcggaaccaggctgcgccctttgacactaagtgtccctaagcctctggttgactttgcaaataagccaatgattttgcatcagattgaagcactcaaagccatcggcgttgatgaagttgtgctagctattaactatcagcctgaggttatgctgagcttcttgaaggcatttgaaacgaaacttgggattaagattacctgttctcaggaaacagagcccatgggcactgctgggcctttagctcttgcaagggacaaactgatagatggatctggggatccattttttgttctcaacagtgatgtcatcagcgaatacccattaaagcaaatgattgatttccatacaaaacatggaggagaggcatccatcatggtgaccaaggttgatgaaccatcaaagtatggtgttgttattcttgacgaggagacgggaaaggttgagaggttcgttgagaagcccaaggtctttgttggtaacaagatcaatgcaggaatctaccttctgaaccccagtgttttggaccgaattgagctgagacccacatccattgaaaaagaagtgttcccaaaaattgcacaggagaaacagctctatgctatggttttacctggtttctggatggatattgggcaacccagagactatatttcaggcctaaggctctatttagattctcttcgaagaaacacctcggataaattagcaactggggttaacattgttggaaatgtgatagttgacagcactgcacagattggtgagggttgcttgattgggccagatgtggccattggcccaggttgtgtgattgaggcaggagtcagactgtcacggtgcaccattatgcgtggagtgcgcatcaagaaacacgcttgtgtgtctggaagtatcattggttggcactctactgttggtcaatgggctcgcgttgaaaacatgactatattgggggaggatgtccatgtttctgatgaggtatacagcaatggaggtgtggtccttcctcataaagaaatcaaatccagcattctcaagccagaaattgtcatgtgattggaaagatgaagaagacctggtagctaattggttattgtaatattaatgttactggtccatatcctagttttttggggtgggtaggagggataatcttctattatgttgcaggggctttcattctttcagtctccctcaatgagagactcagatcctccttcaacaactgacaaccaaataagctccctacagtacagacaactctagaagaagatgggttctaaagaagaagataaaaaagaccaatcaagtaaactgacaaccaaataagctccctacagtactgacaactctagaagaatatgggttccaaagaagaagatagaaaagaccaatcaagtaaagaaaggttatagggattctctgcaaaacttcatggaaaagatccaactgcttcaggctataagaaaatcatgtctgtcttctcctctgctacatcatggtgtattttttttggtggtcaattttgtgctatcttcatttgcaggcctgtacagaaggtagtattcattatagcaactctgcttctatctctgaaatctttttgcaagaggctgagatctctgatttttccaagtactttaatttttagctctctgactccctgccaaattctaatttaataaaaaatacatatttttgttttaaaaaaaaaaaaa

SEQ ID NO: 54 - DNA, 2247 bp, Pinus radiata
ctccatttttataaaactattgaccatctgaatttgggtccccatgctttatttctggccgctagatgcaaacatcacgactgccacgacttgggcagtgtgctgttgattcgcagcagcctcaaactgaagtcatctgtctgttccttgttttgctcgttgtctttttacagcattcagtcatcacagggctggatccagcgagtggaatggaccgagaaacaccttagcaaatatttgatgctggcccgggcataattggttactccacttaaaaaactggtgagagttgagagataaattgattgaaggggtaaacccatatttgtggcttcttgtttttatgaatacagagtagcgtagtacttttgatcacccttaaattattaaaaaaaggacgaagacaatctacagcgcttttgtctggaactgtccggaactcaacagttcgcagggtccctagacagtgtgaagggaggaacgtgggagaaacgtaagccgaacgccgtggttcacaactttgccagccccttttgttcacaactatgcatggttatcgctgcaaaatcgcccctccaaaaccagactggttttgaacttccatccatataggtgaaatctagtgatttcggcactgttacttaaattcagcttaattcaagtagccgacgactgtggaggagatccttcgttgaaagagtaagtcaatttagtataagagatgtcgattggtgatagaaagtccgttgctgtcatcatggttggaggtccaactaaaggcactcgcttccggcctttgtcattgaatctggctaaacctctctttccattagctggacagcctatggtgcatcatccaattctggcctgcaaaaagataccaaatttggctcacatttatcttataggcttttacgaggagcgggaatttgctctctatgtttcatcgatttcaaatgaactcaagattcctgtcaggtacctgagagaagataagccacatggttctgcaggtggactttaccatttcaaagacttgattatggaggacgatccagcaaatatatttttgctgaattgtgatgtttgctgcagctttcctcttgcagatatgcttgaggcccattgcaaatatggtggaatgggaacaatcttagtgattaaggtgtctgctgaatcggccaaccagtttggtgaattggttgcagattctgtcactggtgaactactgcactatgcagagaagccagagacttttgtaagtgaccgaatcaactgtggtgtctatgttttcaccccggacatatttttgggaatacaggatgtttcaacccagcgaaaggatagagcaaccatgcggcgtgtatctagttttgaggctcttcagtctgcaacaaaggccctgccaacagactttgtcaggttagaccaagacatattgactcctcttgctgggaagaagaaattgtacacatatgagacatcggatttctgggagcagatcaagactccaggaatgtctctgagatgctcttcactatacctttcacaatatcgacttactagtcctgaactcttagcaaaaagcaatggtggtaggactgctactattgttggtgatgtttatattcatccttcagcaaaagtgcatccaacagcaaagattgggccaaatgtctctatttcggcaaatgctcgtattggggcaggggttagattgattggttgcataattcttgatgatgtagaactgaaggagaattcaattgtgatgcactccattgttggctggaagtcatcaataggaagatggtcgagagttcagggtgaggcaaattatacgtcaaaacttggaattacaattcttggtgaggacgtgactgttgaagatgaagtagttgtggctaactgtattgtacttccccataagatgctcaatatgagtgtacaagaggaaataattttgtaacttgtgctcatttttatttttctttcttaacacatttgagaacatggctagccattttaggctcgatactgtatcaatttcagagcatattcagaagtgttttatggattcaacccatagcgagattaaattaattgtaagagaaactccatagcaagattaaattatttgtactagaattttgtgagtgtaatatattatttgatgagattgtgtctgagcattatattaacagttggttttggacgtaattgataacttcgatttcaaaaaaaaaa

SEQ ID NO: 55 - DNA, 1833 bp, Pinus radiata
gcgatctttttatctgtgtgcgtatcatataggaccttttcttaatcccccaggaagcgccattgtctccatagaccatgtgattattccttcaatatccctcaatccaaaacaattcggaaaaaaaattgaggactgcgagttaaaaaaagggggaattccagataagccttgaggaaaacatgtacttggctacagcgtctgcttcgctgtgatacacgctaaccacgtttgaaatggggacgcctaaaatttgagatctgccagcatatatagtctgcattagcggagtcctttctgatataaatctgcaatctgttgcctcgcttccagattgaatcgcggggattcgaacggcagacattgatctctctaaggcgtggaaggagcaggggaaggttattttcaggtggtttcataagcggatctactgaatagacgatgaaggcactcattttggttggtgggttcgggacccgtctgcgtcccctcactctcagcgttcccaagcccctcgtcgacttcgctaataagcctatgattttgcatcagatcgaagctctgaaagcaattggagttgatgaagttgttttggccatcaattaccagcctgaggtgatgctgagctttttgaaggagtttgaagcaaaggttgggattaagatcacatgctcacaggagactgaaccaatgggcaccgcggggcctttggcccttgccagggacaagctggatgatgggtctggtgagcccttctttgtactcaacagtgatgtcatctgtgagtaccctttgaagcagatgcttgaatttcacaaaaagcatgggggagaggcctcaattatggtcacgaaggtggatgagccatcaaagtatggtgtggttattcttgatgaagaaactggtcgagtagacagatttgtggagaagcctaagatctttgttggaaacaagatcaatgcagggatttatcttctgaatcccagtgttctgaatatgattgagctgagacccacttcaattgaaaaagaggtattcccaaaaatagcctctaagaagcagctctatgccatgatattgcccggattctggatggatatagggcaaccaaaggattatatttcaggactaaggctttacttagactccctgagaagaaatttacccaagaaattgtcatttggtgctcacatcattggaaatgtgatagtagatgagactgctcagattggagaagggtgcttaattgggccagatgttgcaatcggtcctgggtgcgtgattgaggcaggggtgaggttgtctcgctgcacggtcatgaggggagttaggattaaaaagcatgcttgtgtttctgggagcatcattggttggcattgtactgttgggcaatgggccagagtggaaaacatgaccgttctaggggaggatgtgcatgtttgtgatgaggtatatagcaatgggggtgtggtgcttccccataaggaaatcaaatccagcatcaccaagccagaaattgtcatgtgactgttcaaagaaatcagcaaggaatgcttgcttgcttgcttggctgattactttagtcttgccatttttatgtgaagaggttgcagtggagaagattgtttttctctttcatgtttatctcgagaattgtaggatataccacaggctacataatctctggttttggatttatgatttggtaatcaatgccatgtaagtaatttgttgctgcctataagagatagctctggcaatcctattagtgaatgaaattgtttttattttatcaaatgaaattttctccattagtaaaaaaaaaaaaaaaaa

SEQ ID NO: 56 - DNA, 1821 bp, Pinus radiata
gggtttattttaccagcagttttgcaactccatgaaaaagttgtaacaagatctttcgaattgcagtctgtttggagaaaatttcgaaattcctgcgtacatcgcgtctcaacagtaacgccgaaggataataacggacgaagcaaggatggcaggtgaaggcaaagtgattgctgtcatcatggtgggagggccaacaaaaggtacacggtttaggcctctctctctcaacatagcgaagcctctgttccctttagctggatttccaatggtccatcatcctatacttgcttgcaagaagatacctaatctggctcacatttaccttattggcttttatgatgagcgtctattttctctctacctgtccaatgtgtcaagtgaattgaaaattcctgtcagatacctttgtgaggataaaccccatggttcagcaggtgcattgttcaaatttcatgaccttttgatggaagacaatccaaaggagattttcgtcatgcactgtgatatctgttgcagttttccattggtagatatgcaaatggcacataggaattatggagggattgggacgatgctagttaagaaggtttccactgaagctacagggaagtttggtgaattagttgcagaccctctgacgaaggagttactacattttgcagaaaaaccagaaacacatgtcagtgattatataaattgtggggtttacatttttactccagatatatttgttaccatgcagaccttgacaccaactcgtaaagaacgagggattttccgacgcctctctagctttgaatccttggagttctcatcaccgtcagttcaaaaggatgttatcagattggacgaggacctttttaccccattggtggggaagaagatgatttatacatttgagacatctgatttttgggagcaaataaagaccccagggatgtcattgaggtgctcttctttgtatctaaaacagtatcacatgaaaacacctgaacttttgtcttctgctgatgctatcatgactgtaaatattattggtgatgtttacattcatccttcctcaaagattcatccaactgctaagattggaccaaatgtgtcaatctctgcaaatgctcgaattggtcctggggtgaggctgagggattgcatcattcttgatgatgttgaagtacaggacaatgctatcgtgatgcatgccataattggctggaaggcatcgatcgggaaatgggcaagggtgcagggtgaaagaaattacggagcaaaaaatggtatttcaattctgggtgaggctgttactgtggaagatgaagtcgtagttcttagtagcaccgttcttcctcacaaggctctgaatcagagtgttcaaggggagattattttatgataggttcaacatctgacatgatgtatgctacatatgtatctataattcaaccaattccatattaaaagaataggacaagtggtggttcgaaacaaatgttgaggttgcagggatcagaaattttggaggtgctttattccattctcctagagttaggctgtcagctatatgatctattatatgtttatttcacaattttttttaatcatacaataatttttaaactatcgacatgagctcaataacttgttctgtagtgtgaattgtgcatgcaacttcaatgaaaatgttgttcaacattattcccatactggcatgcggtaggaggaacttcatttccaaacctccagtgcaccttgaaactacaaccattgttaagaagaaattatgatagtgataccatgcatgtttaattctcaaaaaaaaaa

SEQ ID NO: 57 - DNA, 1837 bp, Pinus radiata
ggtcagtctcgatactactattcctcggaatttttatatactttcgagctattttggttcatttactgacgaattcctgatacttttacacctcttggcattttgacatgcattgaagttattttgatacttcagcacattctttacgcaataggattcgcatcaaccgcagcaccctgtctgttaagaaagttcattgatgggcatattagaatccatttttgtgctgtctaccatcggggcatattagaacccatctgcaccagaccctctgtgtcttccatctcggcatatcagaacccatctgcaccaggccctctggttctctgctcctcttgcataaacatatttaactcagaaccaagcaatttcaatatttttcaataacttgcagagggttactgtactcgagcagatatcatgaaggccttaatccttgtgggcggttttggaacaaggctacgcccgcttactctgagccttcccaagcctctggtggattttgccaacaagcccatgatcctgcaccagattgaagctctcaaggaggcgggagtggatgatgttatattggctgtcaattatcaacctgagagtatgatgaagtttttgacggagtttgaagccaaattgggtatccgaatccagtgttcacgcgaaattgagcctttgggcactgctggtcctctggctttagccaaggacaagcttattgatggttcgggacagccaatttttgtattgaacagtgatgtaatctgtgagtttccattgaaggagatgctagagttccacaaatcatgtggtgcagaagcctctgtaatggtcacaagggtggatgagccatctaaatatggtgtagtggtgctggacgaggagactggaagagtgaagagatttgttgagaagccccagatgtttgtagggaacaagatcaatgcagggatctaccttttgaacccaagtgttcttgacagaatagaactgaaacccacatcaattgaaaaggatattttccccaggattgcagaggaaaaccagctttatgcaatggttttgcctggtttttggatggatattggtcaacccagagattatctcaccggtctgcgtctgtatttggactatcttaggactaagtctgatgtgcttgcaagtggctctcagtttcaaggcaatgtgctcattgatgaaagtgtccaaattggggaaggctgtctgattggtcctgatgtttctataggtccaggctgtataattgaagctggggtaagactctcaaattgtgcaattatgagtggtgttagaatcaagaagcatgcctgtgtctcatggagcatagttggctggcattcaacagttggacagtgggctagggcagagaatatgactattttaggtgaggatgtacatataagtgatgagatatacagtaatggtggtgtggtgctacctcataaagagatcaaatctaacattctcaagcctgagattgtcatgtgaaaggttttatgttacatactgatatagcgaagctgcacttcatggttgtatatgaatcgaattgagaatagtagcaatttgatttgctatcggacaatatgctcctaagttttgatagaatctttgaaaatttaaaagtggttccaattttatagtttcaacgactgaaaaaatttgtttgaaatatgtctacacttccgcattccaaatttttggagacatacatgtttccatgtcaattaggatcttttgcgttttccccccatagaatgatatgtttttaaagctggcttgttttaaagtttacaggttggtaattatggcaaaaaaaaaa

SEQ ID NO: 58 - DNA, 1290 bp, Pinus radiata
gggtgaggttcgatccgtggtccgcccgtcgccaactaatatgcttcatcgggttttcattagacaaaataacttcaaattgaattaaacacgtagtttcaagcataagaatcacgttcttggcttatcaatatctataagtgcagtgtgggcagagtggggagtgtgcaaggcagatccacttggatacctggatatacttgcctggaaaatccgctcgcctattctttcagtctttcagggttttttaaacatctactgagatggattgtagaaaggcaggcgtgcttgctttgtttgatgttgatggcacactcacccctgcaagaaaggtcgtttcccaagaaatgttagaatttatgcaagaattacgtaaggttgtagcagtgggagttgtaggtggctcagatcttgcaaaaataactgagcagcttggaaaaactgttatctccgactatgattatgtattttcagagaatggccttgttgctcacaaaggtagcaaagcgattggtaatcagagctttaaagcattccttggagatgaaaagctgaaggagttgatcaattttacacttcattacattgctgacttggatatccctgtaaaaaggggaacattcatagagttcaggagcggaatgcttaatgtgtcacccattgggcgaaactgtagtcaagaagaaagagatgagtttgagcgttatgataaggttcatggaatacgtacaaaaatggttgaggtgcttcgtgaaaagtttgcacctctgaatctgacctattcgattggaggacaaatcagctttgatgtttttcctcagggctgggataaaacatattgcttgagatatgtagagaatgactttcaagagatccatttctttggagacaaaacctacaaggggggcaatgaccatgaaatctttgaatcttcaaagacaatcgggcatacagtaacaagtccagaggatacacgcagacagtgcacagagctttttttccagtgatcctggtttaatccccaactggcatagagctttgacgagattcatatgcggcattaaatcaatgaaaaaaataataactattatcattattatgatgatgactagagggtgaaattggaaatttcttcctatctgaaatatatttcttcctatctgaaatatatttatggcctagagggtgaagttggaattttcttcctacctgaaatatagatttatatctgcgttgatgaagattggcttcagatcaattcatgaactttgcttctctaaaaaaaaaaaa

SEQ ID NO: 59 - DNA, 3711 bp, Pinus radiata
gactcgggaatggtccagagccacgcagaaatttttcctagcactggaacagggccgggatcttctactggatttcgtatcctacgtgttagaggtcgggttatggactattgaaataaatatatttactctcttctgcatgtcggcctttctggttttgcagtagccacttcattcagataggccaaggctttttttataaaagattttcccttattttagttttcgagctatacctaattaaaaactctcaggcaagcgagtctgcattgtctttgatttgatttctgggaatggcggggaatgagtggatgaacgggtacttggaggctattctcgatggaggaggagtcggtgatgataatgactacactcgtcagaagaaggagtcttctgttaagtcaggggttactgtgattccccaattgggggccttcaacccggcccggtatttcattgacgaggtcgtccatggcaccgacgagactgatattcaccacttctgggtcaaggtcactgctaccaaaaacccagaggagcggaacactaggctggagaatctctgctggagaatatggcacatcagccgcaggaagaagaaggggaagttggagcaatccaaaaggctgcagaaattgcgccaagaacgcgaacgaggccggagggatgtcacggaagatatgtcagaggacttgtccgaaggcgagaagttaggaggagacggtcaagggttgaagttttcagaaagccattacaatcttgagctccttaccgagcaatcgcttaaagggaaacgactctatgttatcatgatcagtttgcatggcctagtccgaggggagaatatggaacttggccgtgattctgatacaggtggacaggtgaaatatgttgtagagtttgcaaaagcgcttgcaaaaatgccagaagtgtatagagtggacctgctaacacgtcagatctgttctcctgacttggattctagctatggagagccaactgaaatgctgacttctgatcaggatgatgacattctagagagtggaggggcatacatagttcgaattccctgtggatgcaaagaaaagtatattcagaaagaattgttgtggccatacattccagagtttgtagatggagcactgggtcatattcttaatatttccaaagcattgggagatctgattggagaagacacacctgtatggcctcatgtaatccatggccactatgcagatgcaggggatgctgcttgccttctttctggtgctctgaacgttccaatggttttgacaggccattctctaggccgaaataaactagaacaattattgaaacaaggattgcattccaaggaagatatcaatgcaacgtacaagatcatgcgtaggattgaagctgaagaattgtgccttgattccgctgagcttgtggtgacaagtacaaggcaagaaattgaagaacaatggggcttgtacgatggttttgatttggaactgaatagaaagctcagacagcgagcaaagcgtggtgtccattcttatggtcgttacatgcctcgaatgtcggttatacctcctggaatggacttcagcaatgttgtagtgcatgacgagaattcagataatgatttagataatgattctgttcaattgcccgagtctcctttatggggtgagatcccacggtttttgaacaatccctcgaagcccattattttggctcttgctcgacctgatcccaagaagaacatggccactttagtcaaggcttttggtgaatgtatcaaattgaggaagctggcaaacttgatgttaatcatgggcaatcgagatgatattgatcaaatgcccgcagcaagtgccaatgtgttgaccactgtcctaaagcttattgacaaatatgatctatatggagaagtggcatatcctaaacatcacaaacaatcagaagttgctgatatatataggattgcagcaaagactaagggtgtttttatcaatccggcgctggtggaaccctttggtttgactctcattgaggcagctgcacatggattacctatggttgcaacaaagaatggaggacctgtagatattcaacggacgttgaataatggtttgttggtagatccccataacgacaaggaaattgcagctgctttgtacagactagtagttgataagaacctctgggttgaatgcaggcaaaatggtctgcagaacattcatctctattcttggccacagcattgcagaacatatttgtcaaggatctcccaatgcagaatgagacacccacaatggcagagtgaaaatgaccaaaatgaaaatatggattccgaatcagacagtggttcattcaaggatgcccccgatacatcccttcgtctctcattagatgcagataggccttctcgctctagttcagttaatagcccctttgatctcgataaacttcttcaaaatgaagagaacgtgggaggtatttctgaacacattaggatgatcatagagaagactaaggataaccaatctaaattgggggacacaaatgacgtgaattcacaggaaaaacaaagtatagaacacagtaatagcttaggttcttcagggaaacatcttctcaggagaagaaagcgtctatttgtgattgcagtggattgctatgatgcttctggagaaccccttcttagtagacaagctattatcatccaagaaattatgaatgcagtttgttctgctggcaacttttcatctcctggattcattttatctactgcattaacagttccagaaacaatttctatgcttcagtctatcggaatcaaagtatctgcgtttgatgctctaatttgcagcagtgggagccaacttttatatacagctggtgacaatccagattcacccatatatccagatccagactatgattctcatattgattatcgctggggtgctgaaggtctcagaaaaagcatgaaaaaattgagaggcccagagaattctcggttcctagcggaagatgctgaagcatcgaacttccattgcttggcatatcaagtcaagaacatatccactgctcccaaagcagatgagttgaggcggcaactaagaatgagaggtttgagatgccatgtgatttacactcaaaattgttcccggctgcgtgtgctgcctcttcatgcttcaagatctcaagctttaaggtatttgtatgttcgatggggcttggatatagccaatatgtatgtctttctaggggaaaaaggagatacaggctatgaagagttgattggaggaatgcacaaaacattgatactgaaagggaccgtcgttgatggaagtgaaaagatgctgaggagtcctaccagttatggaagtggagatgtttttccttcggaaagtccaaatatagtgtcagttactgtaagtgatgataatgaagaattcaacagccaacaaataattgcatctctacattggtttgagggatctgcatcctagccgttgcctttttattaaaataaaaagtttctagctaattttagatgaaaaattcctagccaattttagatgagaactactgatgaaatcttatagaagttgtaagaacccaatcagtttgtgaaggattggagctgtcaatgcctcacaagaatgtacaattggagagtatttcaaaaattctctttcactcttaaaaaaaaaa

SEQ ID NO: 60 - DNA, 3624 bp, Pinus radiata
tttttcggttcacgtggcaacaggtctgagctgctcttccgcgtgaagtctgcgattttaatatctgtcccgtttcattttacttcatctttttagtgggctttaaacgccggggtttgttaaagttctgtcgctgcggacacgcagtgttataatttccggacgatttcagtagccgagcttcctttcttcggtaattttattgcctgtatcgtgtgcggagtggtttaattttaagaaaaatggctgggaatgattggataaacggatatctcgaggcaatactggatgctggcgccggatttacagaagccgagactcgacctgcgcttacggttgctgatggcggaggttttaatccgacaaagtactttgtggaggaagtcgttactggtttcgatgaatccgatctccatcgcacatggataaaggtggtggcgatgcggaattccctggaacgtaacaacagactcgaaaatatgtgctggaggatatggcacctggctcgtcgacagaaacagatcgagtgggacgatgcgcaaaggctggccaagaggcgtatcgagcgcgagcaagggcggagagatgccacagaggacatgtcggaggatttgtccgagggtgaaaaggctgatgttgccactcccagggcaacgcccaagcgcgctttttcgcggaacttctccgacttgcaagtctggtctgatgacaataagggaaagcgcctgtacattgtgctcataagcttgcatggtttagtaagaggtgaaaacatggaattgggtagagattctgatacaggcgggcaggttaaatacgttgtagaacttgcaagagcattgtcaatgatgcctggtgtataccgtgttgatttactcacacgccagatttcctctccagatgtcgattggagctatggagagccaacagaaatgttatcttcgggatcttatgatgttgatgggcatggtggaggggaaagcagtggtgcatatatcataagaatcccttgtggtccacgagataaatatattcccaaggaattattgtggccttacattcaagaatttgtagatggggcattaggtcacattctgaacatgtccaaagtacttggggatcaagcgggtaaaggtgatccagtttggccttatgttattcatggacactatgctgatgcaggtgatagtgcagcactcttgtcaggagctttgaatgttccaatggttctgactggtcattcccttgggagaaataaacttgagcagcttttgaagcaaggcaggcagtcaaaagaggacatcaatgcaacttacaaaataatgcgccgtattgaagcagaagaactatctttggatgctgcagagcttgtcattacgagtacaaagcaggaaattgtggagcagtgggggctctatgatggttttgatgtcagacttgaaaagattttgagagcccgtgcaaagcgacaagtgagttgccatggtcggttcatgccccgaatggtggttatacctcccggtatggacttcagcaatgtagttgttgcagaccaagagcctgcagaagctgatggagaccttgcagctttgatcaatggtgatgttaacttatctcctaaagccttgccacccatatggtccgaggtgatgcgttttttcacaaatcggcacaaacccatgattcttgctttatcacgacctgatcccaaaaaaaatctcactactctagtcaaagcgtttggagaatgccggccattaaaagagctggcaaatttgacactagtaatgggaaacagagatgatatagatgaaatgtcgggaggtaatgcagctgttctaacaacggttttgaagctgatagataagtatgacttgtatgggcaagttgcttatccaaagcatcacaagcaatcagatgttccagatatttaccgtcttgctgcaaaaacaaagggtgtgtttattaatccagctctggtggaaccttttggtctcactctcattgaggcagctgcgtatggtttaccgatggtagctacgaagaatggaggaccagtggacatacacagtactttgaccaatggactattagtcgatccccatgatcagaaggccatagcaaatgcattgctagagctcgtagcagacaaaaacctatggaatgaatgtcgccgtaatgggttgagaaacattcaccttttttcatggcctgagcattgcagaaaatatttgtcccgggtggctgtatgcaggatgaggcatcctcagtggcagactgacactctaatggatactactatggatgaggaatcgatgggtgattccctgaaggacgtccaggacatgtctcttcgactttctgttgatggtgagaaatattccgtcaatggctctctggataattctgcggaagttgacaaacttctggcagcaaagggcgacccagaaacatataatcaggtaaaacgaattttggataaactgaaaaagggaccaccatcttctatcactcaagaaactgaacctaagccggatgtaaatgagccaagggctccagcaaataacgtgagtgtttcaaacaagtatctcgcactgagaaagaagaggaagctttttgttatagctgtagactgctatgatgacactggtaatgtatctccccgtatgttggaaatcattcaggagataatcaaagctgtgcgttctgatgcaacagcagcaagatttgcgggtcttgtgctatcaactgcattgacagttgatgaaattctgggcatgttgaactctggcaatatactgcctcatgaatttgatgctttaatttgtagcagtgggagtgaactttactatccaacaattcctgcttatccggatgatggatcaaacaaaaaactatgccctgatccagattatgactcccacattgactaccgttggggtggggaaggtttgaggaaaacaatgtccttgttaactgcctcggaaagagatggccaagaaaagcaggagcgtgttatttttgaggatgcaaagcatagtaatgcccattgccttgcatatgttgtcaaggattcaacaagggttcggaaggtggatgaatttcgtcaaaggttaagaatgcggggtctcagatgccatccgatgttttgtcgaaattccacgcaattacatgtgattccgcttcttgcttcccgttcacaagctttgaggtatttatttgttcgatgggggttggacgtagcaaatatgcatgttttcgtgggagaaactggtgatacagattatgaagaaatgctagcggggttacataaaaccataattttaaagggtgcggtggatcgtggttccgagaaactactacgaggtagtggtagttatcagagagaagacattgtcccttctgaaagcccaaatatagtttctacggaagcgggttacaattgtgaagcaattctgaatgagattcggaaatttggacatatatagaactcaggagacaattgagcccctgtatgaaagagcacttgtaaggaaattatattttgtaaaatagagttaggagaatacattattatttcatatatgtctatttcattatatgtttatttcaaaaaaaaaaaaa

SEQ ID NO: 61 - DNA, 1063 bp, Pinus radiata
gctcaacatatatatatttattctctgcacttgaactgcagctctgcctcgcaaactcttttcccaatccttaatcggcatggacacacctcttcacctcctctttcttttattagcctcctcggcagctcttgcttctgcaaatttctacaatgatgtcgacattacatggggcaatgatcgtgctaaaatccttgacaatggacaacagttgcagcttactcttgaccgctcttcaggttgtggtattcaatccaagcaagagtatctatttgccaagattgatatccaaatgaagttggtacctggcaactctgcaggcacagtcactactttttatctatcatctcaaggtcccaaacacgacgaaatagactttgaatttctgggaaacctgtctggagatccttatattttgcacactaatgtctttgctcaaggccttggtggacgtgagcagcaattttacttgtggttcgacccaaccctggatttccacacttactccgtgctctggacttcaaaccaaattatattttctgtagacgggagtcctgttcgagtgtttaagaacagggagacagagttgggtaaagtggatagcaattatcattatcccaaaacccaagcaatgagggtctactccagcctttggaatgcagatgattgggcaaccaggggtgggcttgtgaagaccgactggactaaagctccctttgttgcatccctccgcaatttcaatgctgccgctacttcttcttttgatgccgccgcagaggaggtggctttggaatcgaaccaagaacagaggcagaggctccagtgggtacgaaagaactacatgatctacgattattgtgcagacaccaagagattcccccagggaccgcctcccgaatgcaaataaaacctcaatcctttgaattcagagaatgaactctgaattctaccttccaagtattctgattcatttctattacattaattctttcattctttctcagacacacatgtaaaatattagagggtatcaatcatttcattttggtactgctatacaaaa

SEQ ID NO: 62 - DNA, 1180 bp, Pinus radiata
atctcttctctcgtttctggaactgctgctctgcatcacaaactcttttcccaatccctaatcgacatcgacatcgacatcgacatggacacacctcttcacctcctctttcttttattggcctcctcggcagctcttgcttctgcaaatttctacaatgatgtcgacattacatggggtaatgatcgtgctaaaatcattgacaatggacaagagttgcagcttactcttgaccgctcttcaggttgtggtattcaatccaagcaagagtatctatttgccaagattgatatccaaatcaagttggtacctggcaactctgcaggcacagtcactaccttttatctatcatctcaaggtcccaaacacgacgaaatagacttcgaatttctgggcaacctgtccggagatccttatattttgcacactaatgtctttgctcaaggccttggtgggcgtgagcagcaattttacttgtggttcgacccaaccctggatttccacacttactccgtgctctggacatcaaaccaaattatattttctgtagacgggagtcctattcgagtgtttaagaacagggagacagagatgggtaaagtggataacaattatcattatcccaagagccaagcaatgagcgtctactccagcctttggaatgcagatgattgggcaaccagaggtgggcttgtgaagaccgattggactaaagcgccctttgttgcatccttccgcaatttcagtgctgctactgcttcttcttttgacgccgctgcagaggaggctgctttggaatcgaaccaagagcagaggctggagtgggtgaggaagaactacatgatctacgattactgtggagacaccaaaagattcccacagggaccgcctcccgaatgcaaatgacccctcgattcaagtcaattcattccattgaatccagcgaatgaatttttctggatacctgacccttccacccattctttcctatcctattacatgatctattctttcattctttttcagacacacagaaacagaaacttccaattattctttcctgttacatctattctttcattctttgtcagaaatacacaaacagaaacgcatgtaacacaatcgattcattttgggtactggtaatacaaaatcgagattcttttgatgaaaaaaaaaa

SEQ ID NO: 63 - DNA, 1181 bp, Pinus radiata
gagcgatttaagcataatacttgtttctttactcattcattccactactatttctttgcgcacgtacatctcgagctattctactcctatcctttgtcgggctccttgcattaacggcatttggatctcaaattcaagctcctttatttctattaatccataatttatggagatgggcaagcccctcctctttcttttcttattaatctcgtcgagtcttcttttaattgtttctgcaaatttctacaacgacgtcgacgtcacatggggcaatggtcgcggtcaaatccttgacaatggccaacaattgcagcttactctggatcccacttcaggttctgggtttcaatccaagaaggagtatctgtttgctaaaattgatatgcaaatcaagttggtacctggcaattctgcaggcacagttactgcctattatctgtcgtctcaaggtcccaaacacgacgaaatagactatgaatttctaggcaacctttccggagatccctatattatgcacactaatatcttcgctcaaggccttggcaatcgtgagcaacaattctacctgtggtttgacccaaccctggcttttcacacttactccgtgctctggacaccaaatcaaattaccttgtctgtggacgggattcctgttcgtgtgtttaagaacagggagacagagttagctaaagtggatagcaattatcactatcctaagagccaagcaatgagggtctattcaagcctctggaatgcagatgattgggcaacgagaggtggcctcgtcaagacagactggactaaagccccctttgttgcatctttcagcgacttcaatgctgctacttcttcttccaactttgccggagagggggctttggactcaaaccaagggcagaagctccagtgggtgcgaaataagtatatgatctacgattattgtgcagacacaaacaggttcccccaggggctacccgcagaatgcaaatgagcattcctgactcaagtactcggtcgtctgattgatgtattttagatgcgctgtccttccaacattctttcttgtattctgttctctgacattcattctgtcactgttttccagcgcataaatttctgcatacaaaatctgtaataatccagaagattaattaattattttgttttgcataaaaaaaaaa

SEQ ID NO: 64 - DNA, 1179 bp, Pinus radiata
acgaggccgcagcaatttcagcctactgcttgttttttcactcattcaatccaatattctttctttacgcacgcatctcgggctcttctcttcctttccttccagatcctccctgcattactctgtccttggtcatggacacgcccctcctcttccttttattgttaatctcatcgacacttctcctaactgtctctgcaaatttctacaatgatgtcgacattacatggggcaatgatcgcgctaaaatccttgacaatggccaacaactacagttgactctggatcgaacttcaggttgtgggtttcaatccaaagaggagcatctgtttgcaaagattgatatgcaaatcaagttggtacctggcaactctgcaggcacagtcactgcctattatctatcgtctcaaggccccaaacatgacgaaatagactttgaatttcttggcaacctctctggggatccttatattatgcacactaatgtcttcgctcaaggccttggcaatcgtgagcaacaattctacttgtggttcgacccaaccttggatttccacacttactccgtgctctggacatcaaaccaaatcatattctctgtagacgagactcccgttcgagtgtttaagaacagggagacagagttgggtaaagtggatagcaattatcactatcctaacagccaagcaatgagggtctattcaagcctctggaatgcagatgattgggcaacgagaggtggcctcgtcaagacagactggactaaagccccctttgttgcatctttcagcgacttcaatgctgctacttcttcttctaacttcgacggagaggatgttttggattcgaacgaagagcagaagcttcaatgggtgcgaaagaactatatgatctacgattactgtgcagacacaaaaaggttcccccaggggctacctgcagaatgcaaatgagcgctcttgactcaactctgtcgcctgattgacgtattttagatgccttcttctttgaaccattctttcctttcttgtattctgttctttgacattcattctgtcactgttttacagtgcatacatttctgcatacaaaatctgtaataatcaagaggattgattattttattttttataatatcaatgtttatatgtaagcggatatagtatactgttgttcttg

SEQ ID NO: 65 - DNA, 1085 bp, Pinus radiata
cagcgatttaagcctcctacatgtttgagcgacttcactcattctttgtttcactactctttctttgcacgcgtccatctcgagctattctattcctttcatcccttgcctacactaatctgcacttggatctcaaattcaagttcctctatttctattaatccataattatggacacaggaacgcccctcctctttcttttcttattaataacctcgtcgagtcttcttgtaattgtttctgcaaatttctacaacgatgtcgacatcacatggggcgatggtcgtggtaagatccttgacaatggccaacaattacagcttactctggatcgcacttcaggttctgggtttcaatccaagaatgagtatctctttgctaaagttgatatgcaaatcaagttggtacctgggaactctgccggcacagttactgcttattatctgtcgtctcaaggtcccaagcacgacgaaatagactacgaatttctaggcaacctctctggagatccctatattatgcacaccaatatcttcgctcaaggccttggcaatcgtgagcaacaattctacttgtggttcgacccaaccctggcttttcacacttactccgtgctctggacaccaaatcaaattacattttctgtagacgagactcctgttcgagtgtttaagaacagggagacagagttgggtaaagtagatagcaattatcactatcctaagagccaagcaatgagggtctattcaagcctctggaatgcagatgattgggcgactagaggtggactcgtcaagacagactggactaaagccccctttgttgcatccttccgcaacttcagtgctgcgacttcttcttctaacttcgcagcagaggaggctttggactcgaaccaagagcagaaactccagtgggtgcgaaataactatatgatctacgattactgtgctgacaccaagaggttcccccaggggctacctgcagaatgcaaatgagcgcccaactcaactccattgtctgattgatgtattttcgataccatgcccttccaacaagtctgttattcattcttttctgctcta

SEQ ID NO: 66 - DNA, 1231 bp, Pinus radiata
atctatataaacaatcgaatgcaaacccatcattcagagtcctctcttctcctcctcgtacttgcatttgaaattgctctgttcttcctcatcttcaaccgtctcctttcaatcataatcacagatatggacacgcccctcctctttatttcattattatccctggcaagtcttgttgtaactgtttcagcaaatttctacaatgattttgacatcacatggggcaatgatcatgctcaaatcctcgacaatggaaaccagttgcagcttactcttgaccacacttcaggttgtgggtgtcaatccaaagaggagtatctgtttgccaagattgatatgcaaatcaagttagtacctggaaactctgcaggcacagtcactacctattatctatcgtctcaaggccctaaacacgacgaaattgactttgaatttctgggcaacctctctggggatccctatgtgatgcacactaatatcttcgctcaaggccttggcaatcgtgagcagcaattctacttgtggttcgacccaactctggatttccacacttactctgtactctggacaccaaaccaaatcatattctctgtagatgggactcctgttagagtgttcaagaacagggagaaagagttgggtaacaattttcattttccgaatagccaggcaatgaggatatactccagcctttggaatgcagatgattgggcaaccagaggtgggctcatcaagagcgactggagtaaagccccctttgttgcatacttcagcaacttcagtgctgtcatctcttcttccaacttcgttatagaggaggatttggattccaaccaagagcagaagctccagtgggtgcgaaataactatatgatctatgattactgtgctgacaccaagagattcccccaggggctgcctccagagtgcaaatgaacctgcaacttcatggatttattcacttgataaattctctataccctgcgcttccaaccattctaatcgttgtgttctattacagtcattttttctgcaactagtattacatatttctacatacacaaaatgtaccaatcagaggggattcattcgttcattttttattttcctgcaactactattacatatttctacatatacaggagtgtaccaatcaaagggaatgagtggatattcccttgctcatttatttggttattggtaataaaaacttgacagtatatttcaatgg

SEQ ID NO: 67 - DNA, 1412 bp, Pinus radiata
atcgtccgtagcgatttcagcctcctggatgttttagtgattttactccttcgttgcactactctttctttgcgcacttccatctcctgctattcctttcctttccttttcctcccctttcatcctctccctgcaataatctgctcttggatctcaaattcaagctcctctatttctattaatccataattatggacatgggcatgcccctcctctttcttttcttattaataacctcgtcgagtcttcttgtaactgtttctgcaaatttctacaacgatgtagatatcacatggggcaatggtcgtggtaaaatccttgacaatggccaacaattacagcttactctggatcgcacttcaggttgtgggtttcaatctaagaatgagtatctgtttgctaaaattgatatgcaaataaagttggtacctggcaactctgccggcacagttactgcctattatctgtcgtctcaaggttccgaacacgacgaaatagactatgaatttctaggcaacctgtctggagatccctatattatgcacaccaacatcttcgctcaaggccttggcaatcgtgaacagcaattctacttgtggttcgacccaaccctcgatttccatacttactccgtgctctggacaccaaatcaaattacgtatgtatcctaattactcattcatctcttcaatattaatacgataaaatctctcaaaaataacaaaaagacatgtttgttattcagattttctgtggacgggattcctgttcgtgtgtttaagaacagggagacagagttgggtaaaatagatagcaattatcattatcctaagagccaagcaatgaggatatactccagcctttggaacgcagatgattgggcaaccagaggtggcctggtcaagacagactggactaaagccccctttgttgcatccttcagcaacttcagtgccgctacttcttcttctaacttcgccggagaggaggctttggactcgaaccaagagcagaagcttcaatgggtgcgaaagaactatatggtctacgattactgtgcagacacaaaaaggttcccccatggactacctgcagaatgcaaatgagcactcttgactcaactctgtcgtctgattgatgtattttagatgccttgttctttgagccattcttttctttcttgtattccgttctctgacattcattctgtcactgttttagcgtacatttttgcattcaaaatctgtaatagtcaagaggattgatttttgtattttttataatatcaatgtttatatgccgatggtgatgctattgttcttcatgtatctgtaattgaaaattgattcacgtgattaatccatcttatcgagttcgaaaaccattgatcgagttcgtatgtaaaaaaaaaa

SEQ ID NO: 68 - DNA, 1536 bp, Pinus radiata
cagaaagcgagatttttctggcttacagtccgtgaatagccccttctcgttttgccttattttgttttggtgttttggctttttacctcggtccgtgattagcccaatctcttttttttttgcttgctgatttgaacatttcgcctgcctggattggttgataaagggcagagggcaaacgaatcccaaaatcgaagctcttctttgaaagtttttttgttgggctgtgggttgaagtattggacaaatcaaaatgatgttggcagtggctctggtgtgtatttgggtctgtgggcttttctcacaacctggttctgcagttgggagttctcggccgagattggccgggaagctcgtgactgaaaactttgccgggcttcagttcgaggaagcatatacgtccttgtttggcgatgaaaatgtcaaggtggcagaggatggcaagaccgtcatgctttcactcgataagcgcactggctcaggattgctgtctcaggacatgtatctgtatggcttgttcagcgcttctatgaagcttcccgatgattacactgcaggcgttgtggctgcgttttatacatcaaatggggacatgttcccgggtacccacgacgagctggactttgaattcttgggcaatatcagaggcaaagaatggagaatccagaccaacgtttatggcaacgggagcacggcctatggacgcgaggaacggtacacgctgtggttcgacccaactgaagattttcatcagtacaccattctttggacagagaaaagcacagtattctttgtggacgacgtccccataagagaaattccgagaacagacgccatgggcgctcactatccagggaagcccatgtctgtatatgccaccgtatgggacggttcagactgggccaccaaaggagggcgatacagagtcaattacaagtattcccctttcgttgtcacgctagctaaccttatcctggaaggttgcgctgttgatcccctggagcagtttcccgcagtctcttgctcagctgacacaacctcctcggcctcactttctaaacttgccgagctctcggaagaccagaaggcattaatggaatggttcagaggcaaatatatttcctactcttactgcgacgatgctgtccgctatccttcaaatccttccgactgtcctcccagggaccctcacaagaaaatcgccactgcacatgtcaagttcggccaccaccagaggcatcacaagaagaatagaaaatcccgccgctcttcttcttccagtgcagcttcggctgctgtttctctctaatcacctgctctgctctgctctactattccaatacagatttttatattatactcttctgctgtctgcttctctgcttgtacagaagacctcgattccgctgctgtgatgatggtggtattagaccatacgattgtaattctacgcagttattattttgtattggaagtattctccggatttaaattttaataaggaatgcttggttggggattctaagaaaaaaaaaa

SEQ ID NO: 69 - DNA, 2564 bp, Pinus radiata
aacgaacacatcccgtgtattcagaaagcgagatttttctggcttacagtccgtgaatagccccttctcgttttgccttattttgttttggtgttttggctttttacctcggtccgtgattagcccaatctcttttttttgcttgctgatttgaacatttcgcctgcctggattggttgataaagggcagagggcaaacgaatcccaaaatcgaagctcttctttgaaagtttttttgttgggctgtgggttgaagtattggacaaatcaaaatgatgttggcagtggctctggtgtgtatttgggtctgtgggcttttctcacaacctggttctgcagttgggagttctcggccgagattggccgggaagctcgtgactgaaaactttgccgggcttcagttcgaggaagcatatacgtccttgtttggcgatgaaaatgtcaaggtggcagaggatggcaagaccgtcatgctttcactcgataagcgcactggctcaggattgctgtctcaggacatgtatctgtatggcttgttcagcgcttctatgaagcttcccgatgattacactgcaggcgttgtggctgcgttttatgtaatcgattttgcatcatttttttaatcagttctccttatttgtcttggtgctcattgaatggaaaagtctgacattagttctttgtgttgcagacatcaaatggggacatgttcccgggtacccacgacgagctggactttgaattcttgggcaatatcagaggcaaagaatggagaatccagaccaacgtttatggcaacgggagcacggcctatggacgcgaggaacggtacacgctgtggttcgacccaactgaagattttcatcagtacaccattctttggacagagaaaagcacagtgtaaaatccccatccccatcacatctcatctattcaatattcacagacaggttttgatcctttatattaactatgaaatggatttgtttgtttgattggccttttccttctcttctcagaattgttgtggaaattcttatgattttatggaatacacctatcttcttgaaatagttgagcttctgtctattgtgaaatagtttttactaacattttgaatattaaatagtgtgattgtgatggttggtggcctcgtctcttatattaacctgacatgattatgaaacgaatttgtgtgtttggtcggccttgtccttctcttcccagaattgctgtgaaaattattatgattttatggaatacacatattttcttgaatggtgacatgttgaaatgtcattcttgaaattgtatgcaattgagataagttttggtttttgtttgatcggctttttccttctcttttcagaattgttgtggaaattcttatgattttatgtaatacacattttgaattgtagcatcttgaaatgtttttcttgaaaatccgcaatctaggtaagttccgctcttgcttgattggcttttatcttttcttctcttctcttatcagaattgttgtgaaattcttatgggtttatgtgtattttatgtgttctcatactctgtgaattttttttatgattttatagaacatacatatctttttgaatggcgagggatcttgaaatggttttttttttttttttaaatctgcaatcgagataaattcagttaaaattgatgaacttatttagaaaatttcgtaaaaacatctcgaaatagcgaaacttgtataaattgtagattttgaaatatttaccgaaacatctctcaaatagtgttagtgtttgaatctcttcttggttttgcagattctttgtggacgacgtccccataagagaaattccgagaacagacgccatgggcgctcactatccagggaagcccatgtctgtatatgccaccgtatgggacggttcagactgggccaccaaaggagggcgatacagagtcaattacaagtattcccctttcgttgtcacgctagctaaccttatcctggaaggttgcgctgttgatcccctggagcagtttcccgcagtctcttgctcagctgacacaacctcctcggcctcactttctaaacttgccgagctctcggaagaccagaaggcattaatggaatggttcagaggcaaatatatttcctactcttactgcgacgatgctgtccgctatccttcaaatccttccgactgtcctcccagggaccctcacaagaaaatcgccactgcacatgtcaagttcggccaccaccagaggcatcacaagaagaatagaaaatcccgccgctcttcttcttccagtgcagcttcggctgctgtttctctctaatcacctgctctgctctgctctactattccaatacagatttttatattatactcttctgctgtctgcttctctgcttgtacagaagacctcgattccgctgctgtgatgatggtggtattagaccatacgattgtaattctacgcagttattattttgtattggaagtattctccggatttaaattttaataaggaatgcttggttggggattctaagaaaaaaaaaa

SEQ ID NO: 70 - DNA, 1625 bp, Pinus radiata
cagaaagaccgggaaaggcctgcccgaacggaatgggtgcgattcactttcacaaatatatatataaatagcgagctggtcgaccatgaccttagatttgaatggtggggatgccctaccatctcatgcctgctgcactgtccgttgaggatgccccgccgcttgggtcgtctttacacttattagttgcccactgattcgtctccaaatccagaaaaggaggtctgctccagggaagggataagtcagtcacggtgaagaagatggctcgaataatcccaatcgtattggcttctgcgatcttattagtggcgtctcttcaatcagaggtcaatgccgccaatcagatcttcaatgccgattttcagatattgtttgcaagtgatcatgtgaagacatctgatgatggccaaatctgggagttgatgcttgataagaagtcgggttctggttttcagacaaagaacagctacagatttggattcttcaccatgaagctcaagcttgttgcaggagattctgcaggagttgtgactacttattatatggcctccaaagactttgagacaagagacgagctggatttcgaattcctggggaacgtaagcgggcagccctatgctctgcaaacaaacatatacgtgaatggcgttggagggagagaacagagaaatgagctctggttcgatcccacggccgactttcatacatactcctttctctggaacgaccatcagcttatattttttgtggatttggttccgctgagagtgcacaggcacaccaatgttacggacaatgtgtatcccaagaatcggccaatgtccctactttccagcatctggaatgcagataattgggcgacaaggggagggctggataagaccaactggtcctacgcacccttcatttcatcttaccagaatttcaatgcagatgcatgtatgtgggaggatccatttccggcctgcgtgtccacaacaggggaaaactggtgggataagccaccggcctggacgcttacagatgcccagaaattggactatgcttgggcaagaaggaatttcctcatatatgattactgccaagacacgaaacgctttaatggcacactccccgttgaatgcagcgttggtccctggtagcctgcagggcctgctcacatgaatcaggcacctgtctgtagtttgattcttctctgaattttttgattctcatcggattgtctgtgctatgtgtgcccaaatccatcatccacagacgcggattcaagttttttataattattggcaatgtatgtttgctctgtgatcttgatcaactgggcaataaagcgaaagatgaggaatctcaatcttgtgttacagagatacacagggaacagtagccttgaataaagctggggagattgcatttgtatacagtctagattatttaatttattttttaattcaattcagtaatacgggcctctgtaatttcttcttccagtttaacaattcatgcagctgaaccttcgtatggtggctgcaatcgcgttatactcgtgtagcgatattttatggattcggtgcggtaattatcttttccaattgaaattgaacttttcctcttcaaaaaaaaaa

SEQ ID NO: 71 - DNA, 1196 bp, Pinus radiata
tcgtttcagattttggatacccactcttctgttctcttcagttcagtcttcaggatgggattggtaggtcgtatgatgcactggccctgtgttctcggtagcattgtagtgttgtgcagcctcatagtcggctctcaatgtgcagccttcaatgatttcttctaccccagttgggctcttgaccatgttatgtacgaaggggagttgctcaaacttaagctcgacaacacttctggtgcagggtttgcttccaagagcacatacatcttcggaaaagtgaatgtgcagattaagctcgttcctgaagactctgctggcaccgttactgctttctatatgtcttcccaaggcgatcagcatgacgaattcgactttgaatttttggggaatacttctggggagccgtacgctgtgcagacgaatgttttttctaagggggttggcaagcgcgagcagcggattttcttatggttcgacccaaccacggatttccattcctattcctttctctggaaccgtcagcaagttgttttctttgtggacgatgtgcccgtacgggtatttgggaacaatgagaaagtgggagtcccgtatcctcaatctcaaccaatgggcgtatactcttcaatatggaacgcagacgactgggctactcaaggtggcctcgtcaagaccgattggagccacgcacctttcgtttccacatacacaaatttcagcatcgatgcctgtgattattccttgaaaacgacctgctcttcgtggtgggatgagcctgcttacgcttcgctcgatgcaaagcagaggctgaaactgaagtgggtgcaagagaaatacatgacttacgattactgcaaagattcagccaggtttcccacgcctccgccagaatgtagtgcttgaagtggggaactcacagaaagtctcattatcacattatcacatatttcattctcctttatgaggttaccacatttctgtcagcttggatgggggaaattactgcgggaggacacgaaagtttatgcttttgtggcggcggaagagagaacagggcctctctgtctctcctcagcctttgcatcgtcattgaagaattttgaagtgctgtccagggcacaattggacttgtaaattgccatccacgacacaatatttacctattttgagggcaaaaaaaaaaaaaaaaaaaaaaa

SEQ ID NO: 72 - DNA, 1115 bp, Pinus radiata
gcatgtgtttgcagagaatttgttgggtaagggcaatgctgatcaagatggtccccaaactgttgctggtgctcttggtagctgcaatggctgctatggctgcctcacctcctaagcctgtggacgtaccattcccaaaaaattatgtacccacttgggctgctgatcatatcaagtacatcaatggtggaaatgaggttcagctttctctagacaaatggacaggtactggcttccaatccaagggtacctacttgtttggacactttagtatgcagataaagatggttcctggtgactctgcaggcactgtgactgccttttatctatcctcccagaatgccgagcacgatgaaatagattttgagttcctgggcaataggtctggacagccttacattctccaaactaatgttttcagtggaggaaaaggaaacagagagcagaggatatacctctggtttgaccccacaaaagattaccatgcctactctgtgctctggaacatgcatcagatcgtattctttgtggacgatgtccccatcagagttttcaagaatagcagggacttaggagtgaggtacccatttaaccagcccatgaaaatatactcaagcctgtggaatgctgatgactgggccacaaggggtgggctggagaagacagattggagcaaagcaccatttgttgcatcatacaggggattccacgtggatgggtgtgaggcctctgtaactgagtcgacttgtgctactcagggtcgtcggtggtgggatcaaaaggccttcgatgaccttgatggaatgcaatggagaaaactgaagggggttcgtaacagttacaccatctataactactgcgctgacaaagtgaggtctccagcaatgcctccagagtgtaccagagaccgtgacatttaatagcagcctcttaggggctcttatttatagatatattaatatatcttctgtaatctattcttcttagatatgctttgttatttatgtcatcgttactgttttgcagtcacaagatgacttatctctgtaatgcttgaaatattaataaagccaatcagcaacgaataaggtgtttcctaaaaaaaaaaaaaaaaa

SEQ ID NO: 73 - DNA, 1229 bp, Pinus radiata
ggacactcctgattcttcaggctttaccagaccatttgtttgcacagactcgttgggtgcttactgaaagatagctagcaggaggctggtgcttttctaggcaatgctgatcaatatggtgcccaatgtactgttatttctcttggtagcggcaatggctgctactgctaccccacctccgaagcctgtggatgtgccattccaaaaaaactatgtacccacctgggcttctgatcatatcaagtacattaatggggggaacgaagcgcagctttctcttgacaaatggacaggtactggcttccaatccaagggtagctacttgtttggacatttcagtatgcagataaagatggttcctggtgactctgcaggcgttgtgactgccttttatttatcctctcagaactctgaacatgatgaaatagactttgagttcttgggcaataggtctggacaaccttacattctccaaactaatgttttcagtggaggaaagggggacagagagcaacgcgtatatctctggtttgaccccacaaaagactatcattcctacactgtcctttggaatatgcatcagattgtattctttgtggatgatgtccccatcagagttttcaagaacagcaaggatttaggagtgaggtatccattcaaccagcccatgaaaatctattcaagcttgtggaatgctgatgactgggctacaaggggtgggttggagaagacagactggagcaaggcaccctttgttgcatcatacaagggattccacgtggatgggtgtgaggcgtctatgcctcactctgcttgtccaactttaggccgtcgatggtgggatcagaaagccttcgatgaccttgatggacagcaatggaggaaactgaagtgggttcgtgataggtacaccatatacaactactgcactgacagagtgaggtatcctaaaatgtctccagagtgtaccagagaccgtgacatctaatagcacagcctccttgggatagatagctatatttttattctattcttcttcgacatatggctgttctaattatgttataactgccatttcgtagtaacaaaatggcttatgtgtgtggatcctgaaatatttataatgccaataggcattttggcattatatatccttctgtaattttcaatatatacttactagtatatggcattaatatttgttcaattctcacaaaaaaaaaaaaaaa

SEQ ID NO: 74 - DNA, 1124 bp, Pinus radiata
gcgcttgagcagtagccactcagcagctgcttctttcttttgtttttgtaattatgggtgggacttggagaacagtgggattgagtttcttgttcttggtgttcagtagtctgattgctagtgtttgttcccagtcccaaggggatgattcatctgctaaggtttttgatgataattttcagataatgtgggctgaggatcatttcaggacctctgaaaatggccaagtatggcacctggttcttgaccagaactcaggttctgggttcaagtccaagtataagtacagattcggatggtttagcatgaagctcaagctcgtaccgggagactctgcaggagttgtcactgcttattatatgtcttctaacaccgacatgaatagggacgagctggactttgagtttctggggaacagaagtggagagccatatgctctgcagacaaacatctatgcaaagggtgtgggtggaagggaacagaggcacattctctggttcgatccaacgacacagtttcacacttactccatcctctggaactctcatcaaattgtgttcttcgtagaccaagttcctctgagagtccacaggcacactgaggctacgagcgatgtgttccctaaagaacaggggatgtacatgttttccagcatttggaatgcagacaactgggcaaccaggggtgggcttgagaagaccaactggactgccgctccattcgtgtcatcgtacaagaaattccatggcctcggctgtaaatggggggatgacaatacaaccctattaccctgtgctaacgataagaatgcaagtgcaagccactggtgggatgaggccgtggcctggactctgacgaagaagcagagggaaaattacaggtgggtgaatagcaaatacttgctctacgattactgcaatgatcagtctcgctactccattaaaccagtggaatgctcagttgctccctgggactgaacacgatgatctcactctcatattttctccgccggtttgaacaagaagctaaaaatccgcgtcagagtatacatagtcagcttccttcgcttgcaatctttgttctcaaataagttattgtgttatagtcataaaaaaaaaaaaaaa

SEQ ID NO: 75 - DNA, 1386 bp, Pinus radiata
ctccagcaatcgccctctgttctgagcttgtgcttgtttctttttacaattatgggcaggacttggagagcaatggggatgagtttcttggtgttggtgttgattggtctgattgcctgtgtttcttgccagtccgacggtgatgattcatctcccaaggtttttgatgataattttcagatattgtgggctcaggatcacttcaggacctctgaaaatggtcaagtatggcacctggttcttgaccagaactcaggttctgggttcaaatcgaagaacaagtatagattcggatggttcagcatgaagctcaagctcgtaccaggagactctgcaggagttgtcactgcttattatatgtcttctgacacagacatgaatagggacgagctggattttgaatttctagggaacagaagtggacagccttatggtcttcagacgaacatctattcaaatggtgtgggtggaagggagcagaggcatatcctctggttcgatccaacgacagagtttcacacttactctatcctctggaacgctcatcagattgtgtttttcgtggaccaagttccattgagagtccacaggcacactaaggctacacgccatgtgttccctcgaaagcaggggatgtacatgttctccagcatttggaatggagacaactgggcaacgagaggcggccttgagaagaccaactgggcggctgctccgttcgtatcttcgtacaagaaattccatggcctcggctgcaaatgggaggatcaaaacacgacccaatcgtcctgtgctcacagtaataatgcaagtgcaaggcactggtgggataagcccgaggcgcggactctgacgaagaaacagagggaatattacaggtgggtgaacagcaaatatttgacttacgattactgccatgatcagcctcgctaccccattaaaccagtcgaatgctcggtggctccctgggactgaacatgaagcttcgttcacggcaaagcttgttctgaaaattctgccttgttattgtgtcatagtcatactcagctagtacggtcggccataacatctaggatggattgtgattaccatagttagtgcgaataatggctgaatagaaattattggagtgttctgcacatttggtataatagaatctgtgtctttgaatttatattgcaatcaatcacgaggataacagtccaatgagtcaactggattggtgtgtatgaactcgaagaaccatctcgaacagtcaattaaattattaagatagacctgcattgaattcgttttgtctgatccaaactcctaatcgtgatttgacagtgaaatttcaatcaatacaataatgctaaacctgcttgttttggattaaaaaaaaaa

SEQ ID NO: 76 - DNA, 998 bp, Pinus radiata
ttccggtctgttgttgtgggtaataggatggccgggcaaaggaattggttcaagagaatcgagtttattgttatattcgtggtttgcttaaactctgtttctgcacgcccggcatcatttgcagaggattttaaagtgacgtgggcagatgaccatgtcaaaacaaggtcagataacaactccatcgatctcatcctggatcagaattcaggggcaggatttgcctccaagaatcagtacatgtttggacttgtaagcatgaacatcaaacttgtggcgggtgattctgcagggacagtcactgctttttatatgagctcggacaaggaggaagtgcgagatgaattggatttcgagtttctggggaacagatcaggccagccttatacagtccaaacaaatgtgtttgctctcgggaagggtggccgcgagcagagagtgaatctctggttcgacccttcgctggaatttcacagatattccatcctatggaaccattaccatattgtgttttctgtagatgatatccccattagggtttacaagaacaacgaagcgagaggtgttccatttccgaagaatcaaagcatggggatcttctctactctctgggaagccgataactgggcgacgaggggcgggctggaaaagattgactggagcaaggcgccattcgttgcctcctacaggggatttgagatcgaatcctgccagtacccgggtaacgcgagctgcgtggttaacaccagcaattggtgggaagggttgagctacagcggcctcagaccaaatcaagcgaggttatacaaatgggtgaggacgaattacatgatttatgattattgtaaggacacgcccaggtatccagtgctgcccactgagtgcaacgctggcatctgatcggccactccccacataagtattaggctacgttctgtaattgtgaattttcgaaatatattcgaatctaatgaatattagtaattgtaaaaaaaaaa

SEQ ID NO: 77 - DNA, 1222 bp, Pinus radiata
cgattctgttctaagcagaccagggattcgattggacccttcaacattatctgccaaatttgatcaatatcgtttgcatctatggaggtttctagcgcttcatgtttacgaggttatgtccatttccttttgactgccattatctgcacagctatatctcccacagtttatgcagatatctacagtgatattgatgtaacatggggcgaaaacaacgcttgggtattgaacaatggccagggattgcagctttctcttaccaattattctggttcgggatttcaatcgtataaggagtttttgtttggaagcgttgatatctccatgaaactggtgcccgggaattccgctggtaccgttacgacatactatctatcttctacaggtgaggggcacgacgaaattgatatggagttcctaggaaatgtttctggggagccctacattctgcacacaaacatttatgtcaattgttcagccgataaagagcagcagttctatttatggttcgaccctacagcagatttccacaattactctattctctggaacccccagcaaattgcgattttcgttgatggtttgccaatcagagtatttgcaaacaatgaaaacataggcgttccctatccgaatgagcaggcaatgagagtattctctagcatatggaacggagaccagtgggcaactcaaggggggcgggtgaaaatagattggtcatcctcaccctttgtggcttcctatatgaatttcaacactgacgtctgtgaatggaatggaaatggcagcacctcgcagtgttgggccactaactggtggaatcagaacaacttgaactatggtcaacaaggacaactacagtgggttcgcagtaattatctcatatacgattactgcaaagattatgcgagatttaattatcaacttccggccgagtgcgcacagcaaccacagtaaaataacttgaactatgctcaacaaggacaactacagtgggttcgcagtaattatctcatatacgattactgcaaagattatgcgagatttaattatcaacttccggccgagtgcgcacagcaaccacagtaaaatataattgcagtacaaatcttaatgtatgccgttgaggttggattcctttccgattccattaaaatcctattttatgaaaataaaccccctcttggtctaaataaaatccaatttcacctcaaaaaaaaaa

SEQ ID NO: 78 - DNA, 1371 bp, Pinus radiata
ccatttccgcgtgcccggctgatcaggtcttcatttttctgcaaaataatttcattttgtgtaacatcgatgtgctcggaagcgatgaagactgcccaatttctgggtctgtttctcattctactactccattctgctgccatggctgccacgcccaagccagtgagtgtgcccttcggcaaaaattacggtgcaagctggggctcagaccacatcaaagaattccatggaggtcgaaaggtcgaacttcttctcaacaaacagtatggtgcggggttcgaatccaaggggacatatttgtttgggcatttcagcatgcagattaagttggttcctggtgactcggctggcactgtcacggccttctatctttcttctcaaactgcagagcacgacgagatagatttcgaatttttgggcaacaggtctggacaaccttacattcttcagaccaatgtattcacaggaggcaagggtgagagagagcatcgcatatatctctggttcgatcccaccaaggattaccattcctatgcagtactctggaacatgtaccagatcgttttttttgtggactcggtaccaatccgcgtgttcaagaactgcaagaacctggggataaggttccctttcaaccaaccaatgaagatctattcgagcctgtggaatgcggataactgggccacccgagggggtctggagaaaaccgattggagcaaggcgcccttcaccgcctcctacaagcaattccacgtcgatgcctgcgaagcttctgtttcggagtcggtgtgcgctacgcaggggcggcggtggtgggatcaggtggagttcagagacctggatgggcggcaatggcggttcttgaaatgggtgaggaagcactacactatctacaattactgcaccgacgccgccagaaacaagaaaatgccgccggaatgtgtccgcgatcgcgataacatttagagattttttgttagcgatgatggacgccatcagcatcttatgctaccgtcggactatcaaatgtttgggagaatcgattttttcgggtgataataattcgtatttgtttccttcagaaaaatataacaatgcgtttgtttactataaagggggcctctcgagcttattatagtgtggcttgtgatgcctaatcttgcatcgtttaattcaagggttgtttgaactttgccatggatctgcttaatgtcatggtatattaatgtaatgggaaaaagagtacggccatattatttgttttccgtacaaaaaaattgtttttaatgcccaccaataaaacaatatttacgcagcctggttgaaagcagaggcagcaatggctacggctggttcgagacaaaaaaaaaa

SEQ ID NO: 79 - DNA, 1298 bp, Pinus radiata
catctccaatcacttcacttgcagcagctgatcatctgaggaaactggccgcagcagcaatgtatgactgcaagcgccagaacaccattaagccattcactggccattttcatgcgttactagtgcttgcatttgtcctaatagtttcagtttgtccgaatgctgatcatgtccgagtatcagaagcagcgagaaggggtcacaaaggcagatatcctcgagcttctcagtttcctacggtggcgtttaatagagggttccatgttctctggggtccccagcaccaaacaatctggaatgatcagtctggaataaccatttggctcgacaggaactcgggaagcggatttaaatcgctgagaccgtacaagtctggctacttcagtgcagccattaagttgcaggctgggtatactgcaggagtcaatactgccttttatttatcgaacaacgaggctcacccggactaccacgatgaaatagacattgaatttctgggaaatatcccgggaagaccttataccttacagaccaacatttatgtaagagctggaaatgcgggacgagggaggattattacaggaagggagcagcaaatccacctttggtttgatcccactaaggattttcatcgttacagcattctctggacaccattgaagattatattttttgtggatgacatcccaataagaaagtatcgaaggacgaacccttacactttcccggcaaggcccatgtggctgtacggatcgatctgggatgcatctccttgggctacagataacgggaaatacaaggtcgactacagttaccaaccattcgtcgcccagtacagaggcttcgtcctcgcgtagtgcacggaatcgaaggcggtcgcaagctccggaaaaaaaaagagagcagtaaataattaaacatctcattacaatatttatatggaataaccatgcctgaagggtactgtaactgtgtacaattatttcaggtaaaaaggtcagaatcacctgattggtctgcgttatgtcggtttttcataaaataagatgtatgcctgctacgtgtatggacattgttattcaacttttctggaaaatcacgaagaaatcgtgtattttgatttgatgctataaagtaaatggatcttgtcagttttgtacagtgttactatatgtcggccgtgggaattttagaactgttgagcatgggaaactcaatagcctattctcatgttcagaggcccaatattttattttggctgggattcgaaacccaatttgattgtatgaaaaaaaaaa

SEQ ID NO: 80 - DNA, 1361 bp, Pinus radiata
ctttcttacgttcaaaggaagagtcgagaaggagaatggcgggttacgaaggaaggcgtatctgcatatactggtgggttattactgtgatgctgtgcagactggtagtgggctctcaatgtgcagccttcaacgatctcttctacgccagttgggctgctgaccatgttatgtcgcagggcgatttgctccagctcaagctcgatcacacttctggtgcaggatttgcttcgaagagcacatacttgttcggaaaagtgaatgttcagatcaagctggttcctggcgactctgctggcaccgttactgctttctatatgtcttcccaaggtgatcaacatgacgaattcgactttgaattcttggggaacacttcaggagaaccgtacgttgtgcagacgaatgtttattcaaatggggttggcaacagagagcagcgtatttacctgtggttcgatccaactgcgaatttccactcctactcctttctctggaatcgccaccaatctgttttctttgtggacgatgtgcctattcgggtgttttccaacaatgagaaaagaggagtcccatttcctcaaacccgccctatgggcgtatactcttcaatatggaacgcagatgactgggctactcaaggtggccgcgtaaagaccgattggagccacgctccttttatttccacatacacaagtttcaacatcgatgcttgcaaatatagccctggcagttcatgtacttcgtggtgggatcagccggcgtacgcctcacttaccgcaaagcagcgcatgcaactcaagtgggtacacgagaaatacatgatttacgattactgcaaagatccagttagatttggtacacctccagcagagtgtactgcatgatgtgggctcttttaacttgacttcctacccattccatgatcttattcacaaatatttgttccacttgtattagttttagtagagtcctgtgcattcctgatagcttggatagtgaaatctctttatatggatatgataaccattaactacggtagattgttcatctgatcacaccaaagtttatgttttggtggctcagcacaagtacatattaagcgtaggatttgggaacgagaagagagcgtctccgtctctcctcggcctgcagtgacattgagaagtgcaggatattctccaaatccggagatacgtcgttggtttgagaatggccacaggctttgaagatacgtcgttggtttgtaaatggccacatgtcttggctttgaattgtatagaagactttggaacagaatattaaataaaaatatgagcatataggcccttgtcataccgaaggccgtttaattaaaaaaaaaa

SEQ ID NO: 81 - DNA, 1098 bp, Pinus radiata
acattccattcttctctggttattttcaatctctgaagtggggggtaaatttcaagactggtcctgtctgacgtattgaaaatgtcgaccaacggtgcctatctatgggccttggtgtgggcttctgttatatctgcaggtttaggccttggaaatggaaactttgatgatgatttttacattatgtgggcacctgatcatgtcaccagactgtacaatggacatggcgtgcagattagtatggacaggcagtcaggttctggcttcgcaacgaagaaacaatatttgtttggcaagttcgaaatgcaaatcaagcttccaccaggaaattctgcgggcactgttgtggctgtttatttgtattccaatcagccaaacagagacgagatcgacattgaatttttgggcaatgttgatggcaaggacatcatcatgcagactaatgtttttgctaatggctacgatgatcgagagcagcggatcaaactctggtttgatcccacagcagattttcacacatacacaatcttttggaaccgttaccacattgtatttctggtagatggcttccccatcagagtgcatcaaaacaatgcagtgcgaggcataccatttccaagaatgcagcccatgtctttgtacacaaccatatggaatggggagagctgggcaaccaacggaggaaagacaaagatcacctgggagccttacccatttgttgctcagttcagaaacttttacatcgatggctgtgagtggaatggaaaccctaggttctgcaagggaggcagcacacaaaattggtggaataagagaacatatgcttactttaacgctggggatagactcaaactccattgggtaaggaagcattatctcgtctatgactactgtaatgacaaggtcagattcaaagtagcccctgaggaatgcaggtaccacatttaatccatagcctgccgagcattttttagtatttggtaataagacagtctggtggaggagaggcactttccattaccggatgctacagaaccagcgtgtggagcccaggagctcctttgagaatttctgaaatctgcatattgagcccagagc

SEQ ID NO: 82 - DNA, 1169 bp, Pinus radiata
ggagaaactcatttccattagcttgcagctgaacatctgcaagagccataagtccatcatggcattcattaggaagcttccattactggtccttgcatttatgctagtcctttcagttgctcatattcaagtatcagaagcagcagggaggcctcagtcatctcatggcactgcttatcctcttagatctcagctctctgctgtgaagtttaatcaagcctttgacgttctttggggtcctcagcacgaacaagtctcaaatgacgagtctgggattaccatttggctcgacaggaactctggaagtggattcaaatcacagcgggcatacgactcaggctacttcagtgcagctattaagctgcaggctgggtatactgcaggagttaacactgcattctatttatcgaataacgaggttcatccggactcccacgacgagatagacattgagtttttgggaacgataccagggcaaccatataccttacagaccaatatctatgtacgagcagcaaatggggggacagagaggattatcacggggagggagcagcaaatccacctcccgtttgaccccaccagcgatttccaccgttacagtattctttggaccccatctaagattgtattctcagtggacaatgtcccgataagaaagtattcaaggacgggctcggctttcccaacgaggcccatgtggctgtacggatcgatctgggatgcatcttcttgggctacagacaatggcaaatacaaggtcgactacaactaccaaccattcgtagcaagatacacagacttcatcctcaccgactgcacacaatcacgggcagcagaatgctcatgaaaagaagaataataataaattacagtaaacatccaatacaaatatatcagtggattcatgcggtattcggcgctacaagtgtatataagtatatcctgtaagcaaagtcagaatcggcatccatgattggctctgtccagtaggagtataatctattattaaaagggttagtcccgctgtatgtttatccataaaagagtttgtatagctgtttcgtgtacgaactgtaatgttccagaccagtattgtcaactgttataccggaagcggtaagagctctcccgtgtattgtgatttgatattagtaaatataaaggga

SEQ ID NO: 83 - DNA, 1284 bp, Pinus radiata
ggaacaagttcttcaatccttattcattctgttgcaaacccaaatcaaataggcagtcaattagattagtctgccactgttgtatcctcaatacttatccaacaatatatcatcaatggaggctccaaatctatctggctatctccatctagttcttatgattgttataatatggagtactggtatatatcccacagtccatgcaaacttttacaatgatatagatatagcatggggttataacaacgtcaacatattcgacaacggagaggaattgcagctttctctcaataatgcttcaggctcggcatttcaatccaaagcacaatttttgtttggaagcgtcgatatgtttatgaagctcgtgcccaaaaattctgctggaacggttacaacattctatttatcatcgacaggcgacaggcacgacgaaattgatcttgaatttctaggaaatgtttctggtcagccatatattctccatacaaacatctatacaaatggttcaggtaatagggagcaggaattctatttgtggttcgatccaacatcagaatttcacaattactcgattctctggaatccgcagcaaattgtgctttttgtagatgggctgcctatcagagtgtttgggaacaatgaagacataggtgtgccttacgccaacgggcaggcgatgagagcgtactccagcatatgggacggagatagttgggcaactcaaggcgggcgggtgaaaatcgattggtcttactcaccctttgtggcttcgtacagaaatttcacagcagacgtatgtgaatggacaggcagtggcagctcctcccagtgttgggctaatattcccagtaactggtggaatcaggcagcttatgagagcttgacctatgcccaacaaggacaattacagtgggttcgcaataattttctagtttacgattactgcaaagatccggccagattcaataatcagcttccagctgaatgctacagacaaccataaaataattcctggtgttccatgcgattccggttggactctttatttgttcattggatttcattccaataaagtgtccctattcgttggcgattaaaaagacttatctcatttgccatcgaaggtgcgaaaataaaattattttctctcttaccgttcttgttctaaccatctgcaacgttttgaaacccacgggattcattgtaggtcaacatatatcatgcatgttcctaaaatataaattgatgatcttgtcatggaacatgttgtcactaaaaaaaaaa

SEQ ID NO: 84 - DNA, 1437 bp, Pinus radiata
atgcccgcgttcactcttccaagcttgtgagctgttttccaccatgggcacatccggcacatcctcacagtatagtagctcagcctttctgcaacccagatcctgcatgaatattatagctgttctcataatattcactcttctaaattccattatccctgtacatggagagtctgagaagcacattcctgtgacctccaggttccagaccataaacttttataatggctattctaatctctggggtcctcagcatcagcaagtgtcagaggatgagtcctctaccacaatttggcttgacagttcttcaggtagtggattcaagtctttggaggcctataagtccggattcttcagtgctgctattaagctacaggcaggttatacagctggagtcattgcagcactctatctctccaataaccaggagtacccaggtcaccatgacgaaatagacattgagttcctggggacaacaccaggaaaaccctacaccttacagaccaatgtttacataaatggaacaggggatgggcaggttctcacaggcagggagttgaagtttcatctctggtttgacccaactgaagacttccataactacagccttctctggactccaagttatatcatcttctatgtagatgatattgctatccgaaagtacccaagaagaatttcatctacttatccattgaggccactttgggtatatggatcaatatgggatgcttcctcttgggctactgaaaatggcaaatacagagcagattacagatatcagccatttgttgctaagttctctaagttcattctcagtggctgccctgtttcagactccacatgctcagccacattctccaattctctcatttcaactggaacaggaggcctaacgagccaagagagatcgaggatgaagtcgattcagacaaacaatttggtctacaactactgcaaggaccgagagcgctatcccactcgcctgcctgagtgtgggaaacgctatgctcccagcctaattaatgggaatgattaaacacataatcaccacttgattatcaagatggttccctagatataaatttgtgagagactagagtttgaatcttgaaaaccagtctctgtttatttatggccatctataatataggccattgaagagtgcttctgtatgggtgtgtaaggaaattttccattgcagctggtgaaataaatttgcagctcatggagtacagatgcccaaagcttcacaggagttgggttgaaatagttgatttccttattgttggtaattgcttggatggctgtgtaaaacttgtcaggtgatgtgttcagtgcatgaaatcatggcccttgtcacagctagatgtatataccaacttctcagatttaaataaaaatgaatgctttatgtccaaaaaaaaaaaaaaaaaa

SEQ ID NO: 85 - DNA, 1333 bp, Pinus radiata
attgaactctgattcatttccactggcttagatacacagtccagtcgaatcgggtcttgaggatggcattcgtaggttgtcaagaagggggtcgtgtcatgcactgcgctcttctttgtatctttgtaacgttgtgcaacctgctcgtgagctctcaatgtgcgtccttcgacgatttcttctaccccagttgggctgttgatcatgtcatgtcccaaggagagttgctccagctcaagcttgataacatttctggtgcaggatttgcttcgaagagcacatacatcttcggaaaagcaaatgtgcagattaagctcgttcccggggactctgctggcactgttactgcattctatatgtcttcccaaggcgatcagcatgacgaattcgactttgaatttctgggaaacacttctggggagccgtacgctgtgcagactaacgtttattcaaaaggagttggcaacagagaacagcgtattttcttatggttcgacccaactgcagacttccattcctattcctttctctggaatcgccagcaagttgttttctttgtagatgatgtgcccgtacggatattttccaacaatgagaaaagaggagtcccatatcctcagactcaacccatgggcgtatactcctctatatggaacgcagacgattgggctactcaaggtggcctcgtcaagacgaattggagccacgcgcctttcatttccacatacaaaaatttcagcattgatgcctgtcagtattcttcgaaaacgaactgctcttcatggtgggatcaacctggctacgcttctcttgatgcaaagcagaggctgaaacttaaatgggtacacgagaaatacatgacttacgattattgcaaagattcagccagatttcccactcctccagcagagtgtgaatgaaatgccctctttaaactcttgagctctcatcaagatcccttgatcatatgagcgatcatttctttgttattgcatgcattcccccctcagcttggatggtagatggaaatcccttaactgcagtgggcgattcatcattttgtaaaacatgaagaaacggaagtacctttcgctggcactgatgtgcagtgagagattcatcattttgtaaaacgtgcagagaccagtgatgtgtttctggggctgcaaaaggagctcacatctaagcgcgagtatgtatgaagtgtaggatgatttacatgtgagaagagaagctccgtatctctgtgtctcttctcggtatgtgtatgtgtattatgtgcagtgacatcagagaatatattaaagtgccttccagagcaaaaaaaaaaaaa

SEQ ID NO: 86 - DNA, 1272 bp, Pinus radiata
tcaaaactcatttttactcattcatattaaattcagcttgttcgcaaatcgggccaacttgttatcacggcatctgtgttcaaaatagtaaagcctagtgagttaatggcatccacaggcagtcaagatgacagcgcttatcgctatacaaccattattagaaaacagggacattaccaaaagcatggctctaggcaccatctctctgcgtccacgggaatacaagtagttatggtaatggccttttttctagtatcttcgtcttctgcagcaagaatttcctcccgccctctgcttagggaccaaaaccgcacagccacaaccgttgatttcgaccagaattacgatataacatggggtaaccaacttgtaaaatttctggacaaccgtcgctcggtggagctccgtatggaccaatcttcaggttcaggcttcgcttccaagaacaaatacttgtttggatatttcagtacacgaatcaaattggtaccaggcgattcatccgggacagtcactgccttctatctctctacccaacaaacctctaagcacgacgagatggactttgagtttctgggaaacaaacccggaaaacctcattatctctccaccaacgtcttcgtcaacggcgttggcaaccgggagagccgaatcaggctttggttcgatccgaccgcagacttccacacctattctcttctttggaaccgccaccagatcctgttcatggtctctggagtagttgtgagagtctttaaaaactctgagacaagcttgggagtcccttacccgtcatcgaagcctatgcaagttattgccagtctatggaatggtgaaaactgggccaccgatggaggaaaatctaagataaactggaagcagtcccctttcatagccactttcgaaggtttcgatattgaaggtcacaagtgcgagggagattctgagtcgtctcctttttgtccatcctctccctcttcagagtggtgggaggacttgggcagcaaaggattgagtgcagaacaaatgaggcagctgagatgggtgagaagaaattacatggattatgactattgtacggacaaaactagatttcccaaacctccacctgaatgtgcattgaatacaatctgaattgcagagccgtcatatagataaccacaaccttaagaacggacgccatatagaaatgaattagtcagatcatatgcatttgatgtacaaattgcgcattattattaataagatgaattcatttatttaaaaaaaaaa

SEQ ID NO: 87 - DNA, 1071 bp, Pinus radiata
gcgacttatttcgtcttcaaccttcgggaaaataatatcatttttaggtaccatccatgttgcgggaagcgatgaagactgcccagtttctgggtctgtttctcattctcctactccattctgctgcaatggctgctacgcccaggacgccagtgagtgtgccctttggcaacaattatgtcgcaagttggggcgcagaccacatcaaagaattccatggtggtcgaaaggtcgaacttctcctcaacaaacagtatggtgcggggttcgaatccaagggaacatatctatttgggcacttcagcatgcagatcaagctggtccctggtgattcagctggcactgtcacggcctactacctttcttctcaaactgcagagcacgacgagatagactttgaattcttgggtaacaggtctgggaaaccatacattcttcagaccaatgtattcactggaggcaagggtgagagagagcaccgcatatatctctggttcgatcccaccaaagattaccattcctacgcagtgctctggaatatgtaccagatcgtgttttttgttgactcggtaccaatccgagtgttcaagaactgcaaggacctgggggtgaggtacccattcaaccaaccgatgaagctgtattcgagcctgtggaatgcagatgactgggccacccgagggggtctggagaaaaccgattggagcaaggcgcccttcctcgcctcctacgagcaattccacgtggatgcctgcgaggcttctgctccgcaatcggcatgcgctacgcaggggcggcggtggtgggatcaggaagagttcagagacctggacggacggcaatggcgttacttgaaatgggtgaggaagcagtacaccatctacaattactgcaccgatatttccagaaacgcgaaaatgcctccggaatgtgttcgcgaccgcgataacgaatagagctcgttcattattaccagtgggcttgttattcgaccttcggattatcgaatgtttggagtagtgatttttcctgggcgataataatagtcatttttttctctcaaaaaaaaaa

SEQ ID NO: 88 - DNA, 1249 bp, Pinus radiata
gcagatgtgcagtacactgttgcgaaaaaagcaagtaacttcgacaatccagccttttaatatcgtcatcatcagcaatgaagcgccgcgcaaagcttttaggatttggaatcaattggcgaaaaatagtgtacataagttcagtcgtgaatctgattctgtcctccgtagaatcctccagtttcaacgacaatttcgatatttcatggggaaccgttcaattgttgaataatggccaaacagcgcagctcactatggataaagcctcaggttctggttttcagtccaaagacgaatacctcttcggcagcttgagcatgagtattaagctggtgtctggaaactcggcaggaacagtcacttcgtattatatgtcgtccgacgcggcttcgcacgatgaacttgactacgaatttctggggaatctgccgggaaatccgtacactctacaaacaaacgtctttgcgaatggcgttgggaatagagaacaaagattgaatctgtggtttgatcccacggcggacttccataactattcaattctttggaaccacaatcaaatcgtattttgggttgattctatccccatcagggtgttcaagaacaatgaagaaactgcgggtatcccatatccgaatagtcgacccatgaggatcctctccaccctttggaacggggaaaactgggccactgatggaggaagagttaaaatagattggagtaaagctccttttgtggcctcttaccaatcatttgaagtgaatgcatgcagcgcgccatctaattcatctcttccatgtgccaacaattggtgggaacagccggaatttcaaagcctagatgaatctcagctggggaaacttgattgggttcgcaaaaattacatgacctacgattactgtcacgacacgtcgggaaggttttctacgactccagctgaatgtgcatttaatgcttaatcaatcaaacacgattgatactaataaatgttacactatggtccgcgcctgaacgaatatactaggcgtaccaaacaacaagtttttctatgaatatactaggcgtaccaaacaagaagtttttctgtcgtctcacgatagaaaaacgctgtatcaaaatacaatctgtatttacactgttgtattagaaaggctgtcaccaacgggagccaataaaaacagctggccttttgcgtaaatattttcttttttaaatttgataaaccgtccctgctcccgtaaaaaaaaaa

SEQ ID NO: 89 - DNA, 909 bp, Pinus radiata
tcattctcgtatcaaccatgaagagccatataagcctgttaggatccagaagatcttcaccagagttggtatatctaagtctcctcatcattctgaatctatgcacggtaaaggccaccttcagcgacaatttcgaaatttcatggggaaacgttagattgttgaataatggccaaacagttcagctcactatggataaagcctcaggttctggttttcagtccaaaatggattacctcttcggcagcttgagcatgagaattaaactgatttcaggggattccgcaggaacagtcacttcatattatatgtcatcggaagcttctcagcacgatgaacttgactacgaatttctgggaaacctgccggggcagccttacactatgcaaaccaacgtctttgcaagtggaattgggaatagagaacaaagattgaagctgtggtttgatcccacggcggacttccataactattcaattctctggaaccaaaaacaaatcgtattttggattgattccattcccatccgggtattcaaaaacaatgaagctgctggtgtcccatatccagatcaacgacccatgaagatcatctccaccctttggaatggagaggattgggctaccgacggaggaagggttaaaatagactggaatgacgctccctttattgcctcttatcaatcgtttgaagtcgatgcatgcagctcttccccctgtgtcaacgattggtgggatcagtcgacatttcaaagtctaaatcaacaacaactcacgcaacttgattgggttcgcaaaaattacatgacatacgactactgtaatgatgcgtcgaggtatcctacgcctccacgcgaatgtgcgttgaatccgtaatcaccagattttggtgcagtaattaaaaaaaaaa

SEQ ID NO: 90 - DNA, 1316 bp, Pinus radiata
caagcttggcatggatttcaattttgtaaacagttccaagcggtagtgttggcgtaccagattcagaacagagtctggaataagaaattacaaggccattgcagtgcaatggcaactagttttagcttctacaaattagtgctcgttgttgctctgttactcacaaatggagctaatgttgtggtaatgctagtctcagctgatcaaagtttgcaacctccattgccttctcagccagtgacaagatatttcaaaaccatggcgtttgatgaaggattttcgaatatttggagcccggaccatcagaatgtctcccaagatcgaaattctgtgacactcaagattgatagatattctggcgctggttttaaatcgaaaaagacttacctgtatggatttttcaatgcggcactgaagctgcaagctggttacacagccgggatcgtcaccacgttctatttgtctaatagtgatgtgtatcctgatctgcacgatgagttagatttcgagtttcttgggacgattccgggggagccttacacactccatacaaacatctacggaaacggcagcggtgatggtaatattacgagtcgtatcggaagagaacagcggtttcatctttggttcgatcccacgcaagaattccacaattacaccatcctctggactcctcatcaaatcatgtttttcgtggacagcattcccattcgacaattccggaagctgaagagtgtgagaaaacagtacccggggaagccaatgtccatctatgcaaccgtgtgggacgggtccgactgggcaaccgatggagggaaacacagagcaaactacagttacgaaccctttctctcaacttacaccaatttcataatcagcggttgcacggctggacaacccgattgcaagcccgggcgtttggatcatcgcttcccgcctatactctccaaggctcagaaagaagaccttcattttgtgaggaaaaactatatgatttacgattattgtcacgatacctctagatatcccaagggtctgcctgagtgtccacgctcatttcctcggaggtcccctgtgtttcgtcctcgtcacgtctgaatatttagatatagcttaaaccttttcgtaatctttgtaccattataaaatgctgcgtgctgctcatcatcatcattcctgaatatgtatccatagatggcttacgccttttcgtaacctccatgccatcataaaatcctgcgtgtcaatgtgacgttgtgtttaagcaacgtttattattatgtaaattattatgttttttctctgcaaaaaaaaaa

SEQ ID NO: 91 - DNA, 877 bp, Pinus radiata
ggaacaatctctgtgatcaaaagcttagatctctggttcagatcttgcccagttggatacatggcagctccaaagtcaagcaacctcagcctgttggctctaatcattctcctcatgggaggaacccatcatgcagtggggatggatttaaagaaaacagagatagaattctacatgcatgatgttgtgacagcctccaagaatttcacaacaatgaaggtggcacacagtcctgaatttggaatgatcagagtaatagacaatgctctcacagaggacctccaacaaaattcaaaggagctgggtagagccagaggtatgtatgtgcaagactctttcagtggggttaacctgttaatggtattgacagttatttttcaagcaggagagcacagtggaagcactctctgcttgcaggggcaggacggtagaaagcagagggagatatcagtggttgggggaactgggcattttcgtcatgctactgggcatgctattcttgaaaagcagttgtcaatgggagaaaatgctattctcaattttaatgtcactgttcttcaccgatcagagcttgcagaatgaatattttctgtattgattttgctttcccaaacctcagaggagccaggcagattaattaagtttggagtatgggctgcaacaaagtatttaatatatggattagtagggaatatctaattctatattcatagaaagtagatatatgtggagttggtatttattattctgctgtctagggcagtatatttaaagattctcatgcaatttttacattgcaaagatataaataattgtaagttatttttgacaatgtaatgaatagttgagtttttgtgtattttatataaaaaaaaaa

SEQ ID NO: 92 - DNA, 719 bp, Pinus radiata
gctgtattgaggtattcgttgtttgagagatggcgacaaagggttttctggaaacaactattgcagtgtccgctgtattgttgttggtttgcctgcacatagcggaagcagaggtaaagacgaaattagggcgggagaagataagccacctgcacttctatttccacgatgtagtgacggggaaaaatgcgacggccgtgcaggtcgcctccgctcctaccaccaagtattcgcccactggcttcggcgcggtcgtggtgatggacgactgccttacggcagggccagaggcgacctccaaattggtggggagagcgcagggtatctacgtttcctctggccaagaggattttcatttgctgatggccaccacctttgtttttgagagcggcatgtacaacggcagcaccctcgccatgatcgggaagaatgcacctctggaagaggtgagagaaatgcccatcgtgggaggcagcggattgtttcggttcgctcgaggctacgcacttgcccacacccattctattgatggtaccactgcagtggttaaatacaatgtcactgtccttcattactagccctgcctttccgtatgtctctgtgatggtatatttctttagggtttatgtagttcttttgttacccatacaactagctctgttttacgtttagatgtaatcatcaattcatattgggaacatatatgctttatgtaaatt

SEQ ID NO: 93 - DNA, 813 bp, Pinus radiata
gttttccccttctctgaggcgcgccattccattacttgtttttgagatggcaaataagggttattcggcagcaactattacagtggccgctgtgctgctgttgtcgttgttttacctggaggcggaggcggaggcggaggcgaagttgaaattagggcgggagaagataagccacctgcacttctattttcacgatttagtggccgggaaaaatgtgaccgccgtgaaggtggcctcagctcccaccacaaattcttcggctactctgttcggcgcggtgatggtgatggatgactggcttaccgaagggccggaggcgacctccaaaatggtgggcagagcgcagggtatctacgtttcgtcgagccaagaggattttcatttgctgatggccaccacctttgtttttgagagtggcaagtacaacggcagcaccctcgccatgatcgggaagaatgcggctctggaacaggtcagagaaatgccgatcgtgggagggagcggattatttcggtttgctcgaggctacgcactcgctcgcactcatgccttcgagttaaataccggcaatgcagtcgttgagtacaacgtcactgtgctccattactagcccagtctctctgtgtatatgaagatatttccttgtagttcaaaatttgtggcgttatgcttttttcgctatacctatgtagtacgaaacccttagtgttatgatcaatgacagtgttctctaccacagtttgtatatttatattaataattatggtgagtgaggtcattttcaaggtcaaaaaaaaaaaaaaaaaaaaaaaa

SEQ ID NO: 94 - DNA, 827 bp, Pinus radiata
ctgtttagacatcttccgctctggttcgatgggtcccaggtttttgtttttggcaatcatcgccaatgtcctcctcatgtttgctgcaggtgaaggtgaagtaaacatggtgttttatctgcatgataatctcactggaaccaacgtgacggccgtcccagttgcgggattgaatggttcgtcttcaaacgcggggaagtttggaaccgtcgtaactatcagcgatgttataaccagacgaccggaaatcagcgaatccgactccgacaatattatcggtcgagcgcaaggaatgtacgtggatacaaaccctgtaactggacttgactttttaatggttttcaccttaatctttgaagataagaagtacaggggcagcactctggagttccagggaacggacaggttcgctcaaccacgacgcgagtttgccgttgtgggaggaaccggcaagttcagatttgctcgtggttatgcagttgcgaacacagaatccctttctggtgttaatgctattatcaaattcaatggcaccattcgtactgattaattttttacgatctagcctctttctgatatgctcacagtgttgcttttcaatattccaccctagttcttttccttagtgctataaataaagtcccgagggcacccggattataaagccccgaaggcaccaggattgcagaaaggccagcggctcagtctaccttgaatctgctgttggccttttgcgcctgacatcggatgattcggaatgcgcccaggaccatgccataataaagaaacagtttaagttattaaaaaaaaaaaaaaaaaaaaaaaaa

SEQ ID NO: 95 - DNA, 857 bp, Pinus radiata
atcatgaagggtttttcggcagtaaatactgcaatggccgctgtagtcttgttggtttgcttgtacctagcggtggcagaagccaaggtgaaattagggccagagaagataagtcacctgcatttctatttccatgacttggtggacgggacaaatgtaacggccgtggaggtggcctcggctcccaccacagactcttactttacacagttcgggttggtgagagttatggacgacccgctgacggaagagccgaaggccacctccaaaatggtgggaagagcccagggtatctacgtttcctcctgccaacacagagtccagctgctgatggcaacgacgtttattttcgagagtggcaagtacaacggcagcaccttggccatggtcgggaagaatgcggttttcgatgatgtgagagaaatgcccatcttgggaggcagcgggttgtttcgactggctcgagggtacgctctcgctcgcactcactccctcgatctaaagaccggcaatgcagtcgtcgaatacgatgtaaccgtcgtccattactaggccttacaagttctgttcatatgtttgtgtggctctgtagggtatatttctttatgttctgtccacctgcctgcgtggctttctagcgtatactttctttgtgcttgtaacttcgctgcagatacacgctttaacatatgtagcgatgaaattttaacttttcgttgagaaggttgtccatatattctgtcaaatttttaactttttgttgagagggttatccatatattctgttaaatttattctgcaacctatggggagatctgataacttcctcccttactctggcctccggaaaaaaaaaa

SEQ ID NO: 96 - DNA, 804 bp, Pinus radiata
gcagagctgaagcatccttttgagatggctatcaaaggttattcgtcagtaaatattacagtggccgtgtactgttattggtttgttctgtacctcgcagcggcagaggccgaggagaaaataggtcacgggaagatcagtcacttgcatttctatttccatgacttagtgggcggtaaaaatgtgacggctgtggaggtggcctcggctcccacgacggactcgtattttacacagttcggtttggtgagagttatggacgaccggctgacgaaagggccgaaggtaacatccaaaatggtgggaagagcccagggtatctacgtttcctcctgccaacacagactccagctgctgatggcaaccacgtttgttttcgagagtggcaaatacaacggcagcaccctcgccatggtggggaagaatgcggttttcgatgaagtgagagaaatgcccatcgtgggaggcagcggcttctttcgtttggctcgaggctacgccctcgctcgcacccattcctttgatctaaatactggcaatgcaattgtcgaatacaatgtaaccgtgctccattactagcccttgcaaggtgtccgtttgtttttgtggctgtgtagggtttatattttctttatataaatactggcaatgcaatgggcgaatacaaagtaactgtgctccattactagcccttgcaaggtgcccatttgtttttgtgactgtgtagggtttatatttcttcatgttccgtgcatctgtttgcgtggttatgtagtgtataatttcgtgatgcttgtaatttcg

SEQ ID NO: 97 - DNA, 983 bp, Pinus radiata
gtggagcagtttcggtttcctaattgatccctgcagttcaaagttctcattagctaatttgcattgaatcccagatcccacatctatagctttgtggcgattggtctatgtttacaatggccatcaagaagtataatagggatgtgcacttgtgctttgtctgccttgtactcttcactgtgatgttgcaaactagtaatgggcatcgctggaagaagcactcactcccaaagccatgtaggaatctggtgttgtatttccacgatgtaatctacaatggctccaacgccaagaacgcgacatctacgcttgtgggtgctccacagggggctaacctcacacttctcgctggaaaagacaaccactttggagatctggcggtgttcgacgatcccatcactttggacaacaatttccactcccctccggtgggcagagctcagggattctacttttatgacatgaagaacaccttcagctcctggcttggattcacgtttgtgcttaactctacagattacagaggcactatcacattctctggagccgatccaatacttacaaaacacagagatatatcggtagtgggaggcaccggagatttcttaatgacaagaggaatcgccacaatctcgacggatgcatacgaaggagacgtttatttccgtctgtgcgtgaatatcacactctatgagtgctactgatattattttctacaattgatcacataatcctccaagtctagctactcatgtccatgcctgcgcttcatttctatgttgattttaagtgaattagtgtttctctcgcttcaaaatctgtgagcggagagtgaaataaaacgtgtagtgttcttgtttttgcttacccatattgtagttcgattttgtggaaactcctcggcagtctattaaatatgttcaacatattaatatgttgctcgagaatttaataagagttttgggtatgttttaaaaaaaaaa

SEQ ID NO: 98 - DNA, 856 bp, Pinus radiata
cattgatcccatatcgtcttctacatcactttagtgtattagattgccaatggcaatcaagaatcataatacagctgtgcacttgggttttatatggcttgtggtgtttagtgctatgttgttgcaatctagtgatgcacacagctatatgaagcgtccactcccaaagccatgtaggaatctggtgttgtatttccacgatgtaatctacaatggcctcaacgccatgaacgctacttctacgcttgtgggtgctccccagggagctaacctcacacttctcgctggaagagacaaccactttggagatctggctgtgttcgacgatcccatcactttggacaacaatttccactcccctccggtgggcagagctcagggattctacttttatgacatgaagaacaccttcagctcctggcttggacttacttttgtgcttaactctacagattacaaaggcactatcacattctctggagccgatccgatccttaaaaaatacagagatatatctgtcgtgggaggcaccggggatttcttaatggcaagaggaatcgccacaatctctacggatgcgtacgaaggagacgtttatttccgtctgtgcgtgaatatcacactctatgagtgctactgatatcatttacttgtacttcgtctcttctctccttcggttttgcgtttctatgttcatctaatttgaattagtgtattccatacggcatatgcatgaatagcatgcatggagcatgttctgtagtgtgagaatcttgtatttcgatctcgtgtaaggccataaccaataagaattcatcgtcgctcgaatcgttttgttttaaaatattgaaaaaaa

SEQ ID NO: 99 - DNA, 1113 bp, Pinus radiata
gggcgtggcaattgatcagtacttgcaacagcttcaattcctgtttcatgggttctagggttttgcttcccgctatggccacggccaccatcgtcatcttcctcctgcacgctgctgcgggtgaaagagagacgaatttggtgttttacatgcacgataatgtaagcggaaacaatgtgacggcctttaccgttgcgggattgaacggtacctcttcagacccgggcaaatttggaaccatagtagttaactgggacgctgccacaaaaggagcacaagccaccggaaccgccgatcccgacaatattgtgggtcgaattcaaggaatgtatgtgaacacaaaccttgttactggccttgattttcttatgcttttcaccgtaatcttcgaggatatggaatacaaaggcagcaccctggagttccacggaacggacaagttctttgccccgcatcgcgagttggccgtggttggaggaaccggcaagttcagatttgctcgtggttatgcaattcttaccacggaagtcctttctggtccaaatgctgtagtcaaattcaacaccaccctccgttactagttaactttcatgtccatggattgaataagtcaggtacggtctccagtttcaaggttgtggtttaacaactattgtggaggttcggtgtctataagtctaggttccgattctgcaagtctagaggtttactctcatgaggattatgtgcctctgagattttcttttcttgaaaaaaataaaaagtccgagatttgcttttctggcaatttcctcggctgaaaataacaagtagtcaggcaaaggccgggcagtactcagtttccgtttgtctatgtctgagatctgctctaagggcgagttcttcagttgaaaaaaattaaaagtcaggcaagggcctcgcagtactgagtttccgtttgtctgtactactgtaaattaaaagtcaggcaagtgcctcgcagtcctcagtttccgtttgtactcccgtaaattatggatttggagttgttcgttttggtgtgctaaattataaagttataaatattattggtggagagaagattttagaattctttttaaaaaaaaaaaaaaa

SEQ ID NO: 100 - DNA, 858 bp, Pinus radiata
ttttaggagaaaaacatttcttttttctcctgaacttgctattcggtcaatactattatattttgcacagccagtagatctatatcttagatgaggaagttcaatgacaatgcacgctcaaatattaacaatattgcagttgcagcggctgcaactactttcttattctgggtagcgctaacaatatttgaacgacacgagatgaaggagaaaacaagctatcttcagttctattttcacgatatagtgtcaggcaaaaatgtgacggccgtggaggtagcttcttctcccaccacaggatcatcctttactgaattcggcctggtgagggttatggacgactggttgacggaagggccggaaccaacctccaaaatgttgggaagagcacagggtatctatgtctcttcctgccaggagaaagtgcatctgcttatgacattaacgtttgtgtttgatagcggaaagtacaacggcagcactctcgccgtggtagggaagaacgcggttttcgatgaagtgagagaaatgcccatagtgggtggcagcggattctttcggttcgctcgcggctacgcactcgcccgcactcattccttggatcttactacgggcaatgcaattgttaagtacaacgtcactgttttccattactaagcatctgtccattgtgtttagtcatattccagtggatcagttccgttggattattaaacattaaaccatagttactaaattcgaattcgaattcgaattcggattcgaattcgatacgataaaaattcgaatggaaaattttcaattcgaaaaaaattcgatagtgtaacattttttaaataacaaaaaaaaaaaaaaaaa

SEQ ID NO: 101 - DNA, 1067 bp, Pinus radiata
gctttctcttgctattgcaattatccttgcattgttttccctataccacgtcttcttatatatttacattataagattggcaatggcgatcgagaataataatagagcggtgtatttgtgctttgtatggcttctactgttcactgtattgctgcaagctagtgatgggcatgggtggaacaaggacccattccgaaggcctagtaggaatctggtgttgtatttccacgatgtaatctatgatggtaccaatgccaagaacgcaacagctacgcttgtgggtgctccccacggggctaacctcacacatctcactgcaaaagacaaccactttggagacttggcggtgttcgatgatccaatcactctcgacaataattttcactcccctcctgtgggaagagctcagggtttctacttctacaatatgaagaacaccttcaacgcctggcttggattcactttcgtgctgaattcaacacactacaaaggaaccatcacattcgctggagcggacccaatacttacaaagtacagagatatatcggtggtgggaggcaccggagatttcttaatggcgagaggaatagccaccatctctacggatgcttatgagggagatgtatacttccgtctccgtgtgaatattacactgtatgagtggtactgatattaatttctactgcttatcatatgagttgcgtctacgtatagtgatcactcctcttgcctgcccttgatttctatttagatccgactgtttcactctatgggaatctgcatgaaggtcccaaatgttgtagcgtccagtgaaagaatctccaatagtgttgctgtttagctttagagtaatgtaatccacccatatccaataaattaaaaaattgtggtaatctactccgaaataaccgagtgatatggcggttttgaggagatatgctttgttttggtacttttgttacaaccattaaattgaaatgtgtttcagattaaaatgtggaactgactaggttgattgttttcccctgggatgatgataaatgattaatattcttaaaaaaaaaaaa

SEQ ID NO: 102 - DNA, 1300 bp, Pinus radiata
gataagttgacaacgaacaatcacatatcgtcgaattgcatatatacatatatctacttttagtttggatggcttcagattgggcgttaaacgagccagtggccatggtcctgaattactcaccggaccaacgcgatacccatactgacagagaaagctaagttgtctttttattcaaatttgcacatgtaccaagccactagtacacagattaagtttctatataaagagttgtatcgccattaatctcagtagttgccgtgaagctttgtcttgccatggtccttaattactcaccggcccaacgcgatacccatactgacagagaaagctaagttgtttttttattcaaatttgcacatgtaccaagccactagtgcacagattaagtttctatataaagagttgtatcgccattacactcagcagttgcagtgaagctttgtcttgctactctacttatccttgaattgtttccctatctcacatctttttcgatatttacttttataagattggcaatggcgatcaagaataataacagagctgtgtacttgtgctttcttatatggcttctagtgttcactctatcgctgcgaagtagtgatgggcatgggtggaataagtacccatttcgaaggcctagtaggaatctggttttctatttccacgatgtaatctatgatggtaccaacgccaagaacgcaacatctacgcttgtgggtgctccccacggggctaaactcacacatctcgctgcaaaagacaaccactttggagacctggcggtgttcgatgatccaatcactctcgacaataattttcactccccccctgtgggaagagctcagggattctatttctatgacatgaagaataccttcagtgcctggcttggattcactttcgtgctgaattcaacagactacaaaggcaccatcacattcgctggagctgacccaatacttactaaatacagagatacatctgttgttggaggcaccggagattttttaatggcaagaggaattgccaccatctctaccgacgcttacgagggagatgtatacttccgtctccgggtgaatatcacactctatgagtggtactgattttattttctactgctttatcatatgagttgcgtctacgtctagagatctctcctcctgcccgctcttcgtttcttacatcgattttagtgttccactctacgagtatgtgcttgatagtcccaaatattgtagcgtcaaagtgaaataatctctaataatgttgctgtttaactttagaataatgt

SEQ ID NO: 103 - DNA, 811 bp, Pinus radiata
gcaagaattgtattgtaatgtaatcttccgattcatcaatatagaacttgagttagagatggccaagctaagtgctggtgttgcatcaaatgttaatagcattgcagttgcagctacgttgttgttattgttgctagcactaacagcggaagctaaagaaggatatgatagcaaggtggaggagaaaacaagcgacctgcatttctattttcatgacacggtctcgggaaaaaatgtgactaccatgcaagtggcgagggctagcggaaccaactcttcccctactcttttcggcctggcggtggtcttggacgacatagtgacgaaaggaccagagcccgcctcccagttgctagggagaatgcagggtctctacactttatctggattagaggaacgagctatgcagatggtggtcacccttgttttctctagcggccaatacaacggcagcaccctctctctggtgggcattaaccgcatttatcatcctgttagagaaatccccattgtaggaggaagcggattgtttcggttggctcgaggctacgtactcgctcgcactcattctctagtgcaaaatggcaatgcggtcgtcgaatgtaatgtcactgttctccattactagtggtgaccacgcagtcccggattgaattttctttctttctactatggttttctctggagatgccacccgtgaaggtggtggtgtaatggccgcccactgctctttgaaaatagcctgtggcataacatcatttgtgtgattcacaggtaaaataaaaagtttcaatttggtttaaaaaaaaaa

SEQ ID NO: 104 - DNA, 723 bp, Pinus radiata
cattcgttctcctttctttcagagatggcggggaaaaattattcgaccgcaactattgcagtggccgttgtactattgtttgtgtgcctgcacatagcggcggtgcaggcaaaggtgaaattagggaacgagaaaattagccacctgcatttctatttccacgatttactggtgggcaaaaatgtgacggccgtgcaggtggcctcggctcccacgaccaacaattactttactcagttcggcatggttagggttatggacgactggcttaccgaagggccggagggaacatccaaaatgttgggcagagcgcaaggtatctatgtttctgcgtgccaagagaagttccagctgctcatggcaacgacgtttgttttcgagagcggaaggtacaatggcagcaccctcgccatggtgggaaagaatgcggtgctggaacaagtgagagaaatgccaatcgtgggaggaagcggattctttcggtttgctcgaggctacgcactcgcccacacccattccatagatttcaagaccggcaacgcagtcgttgaatacaatgtaaccgtgctccattattaggccttctgtagtcgtgcctgtctgaggaggggcaatttttctttcaatttcatgttttgctaccggaaacgttttttcatgtaacgatggaatatcaacagctgttttaattttccaaatttgtcttttcagttaaaaaaaaaa

SEQ ID NO: 105 - DNA, 844 bp, Pinus radiata
gcacttttgagttcatattggtaaggcgagatggcttccaggtgtttgtttgcgaccttggccacggccacccttgtcatggcggccgcgggggaaggtgtcttaaatatggcgttttacatgcacgatcatttgaatcgaaacaaggaccagacagccttccctgtcgcgggagttaatggctcttcctcggaagcgagcaagtttgggaccctcgtggttatcagcgatatggtaaccaaacgaccgcaaatcaccgaatatgacactgaaaatattctgggtcgcgcacaaggaacgtacgtgaatacaaatcctgttaccgggctagattttttaatggttttctccctcatctttcagaatgctgagtataacggcagtaccctggagatacaagggactgagaggttcgatcagccgcatagagagtatgctgtcgttggaggaacgggcaagctcagatttgcccgcggctatgcggttggtactacagtatccacttccggcgaaaatgccgttctcaaaatcaacgccaccttttgtactgtttaattctctataatgtttatttttattgcagtaagtaggtattttcttgggataatctatttagtagctattagcaaataagttaggagtgtttattgtgagattttagggggaaaaggagtggatagagaagcaatctgtcttttaggttatctttagcctcatgggctttaaaataatttctttcttttgcgagaattcgcaaaaaaagatcaagaatcagaaatataatgtgtctcataagttatctttaacttattgcacttatttatcaaaaaaaaaaaaaaaaaaa

SEQ ID NO: 106 - DNA, 683 bp, Pinus radiata
gtaagttcttccattcctgttcgatggcgtcagggattttgtttccagtcatggccatcatcgtcatcgtctccctgcagcctgctgcgggtgaaagtgagatgaatatggtattctacttgcacgataatctcagcggaacgaatgtgacgtcgtttccagtggccggattaaatggctcttcttcagacgcgggcaagtttggaaccctggttgttaccagcgatgtcaaaaccaaaggaccaaactccggctctgacaatattgcggggcgagctcaagggacgtacgtgaatacaaatatggttaatggacttgacttctcaatggtcttcacgctcatctttgaggatatggagtacggcggcagcactctggtgatccggggaaccgacaggttcgatcagccgcagtgtgagtatgcgctggttggcggaacgggcaaattcagatttgctcgcggctatgccgttgttaccacggaatccgtctccgcacccaatgctgttctcaaattcaacaccacctttcttattccttcctagtcaaaatgaggttcttctaactaagtacctactaaataaggtcatggtatgatcaataacggataagggtgtttccaagtcaacattttgacttttggtcgtgtgatatataaatatattttattcccaaaaaaaaaa

SEQ ID NO: 107 - DNA, 809 bp, Pinus radiata
gcacactgctacttctgtcactcttcttgcgcacactgctacttctgccactcttctttaatggccggtttcaagtttctgtttccggccatggccgtcaccatcctcgtcgtcttcctaaaaaaggcagcggctgctgcaattgaaggtgaaatgaatatggtgttttatatgcacgacaatgtgaaaggaaacaacgtgacggccatcccggtcgcaggaacaaatggttcttcgtcacctccaggccattttggcacggtcgttgttatcagtgacgttatcaccaaattcccagatgtagccgagtcggagtctcagaatattgtaggtcgagcgcaaggaatgtacatcaatacaaaccttgatactcggcgtgattttttaatggttttcacagtaatcttcaacaatatggagtacaatggaagcacactggaggtccaaggaacagataggttcgatcagacacagcgcgagtatgctgtaattggaggaacgggcaaattcagatttgctcgcggttatgcagttgttaccactgagtccctctctggccagaattctgttctaaagttcaacaccactctttccactctttagtattattataccttttgttttcttgcttcgacttccgcacttctttctcaataataatgccgtgattataaagtccggcgatataactataacttgtttgtatgttttggtgggtgtatgttttatataatatatatatagttaatggcacagcacagtgttacagtgttaatctgtaaaactgttatttttaagtaaaaaaaaaa

SEQ ID NO: 108 - DNA, 937 bp, Pinus radiata
actctagtcacactgagacacaacacagttggttattgagtcctgctctgctctgctctgctccttggaattctagttaaccttcaattcgcccacgaattcctctccatcactttcgccaatggcgatcaagagtggtagggctctgcacttgagctttgtgtggcttgtgttgtccactgcgttattgcaaactagcgatgtgtatagctggaagaagaaaccactccgaaagccttataggaatctggtgttgtatttccacgatgtaatctatgacggtaccaacgctgacaacgctacttctactcttgtgggtgctcctcactgggctaacctcacacatctcaccgcaaaagaccaccaatttggagatctggcggtgtttgacgatccaatcacacttgataacaattttcactcccctccggtgggcagagctcagggattctacttttatgacatgaagaacactttcagtgcctggcttggattcacgtttgtcctcaactctacggaccacagaggcaccatcacgttcgctggagccgatccaatacttaccaagtacagagatatatcggtggtgggaggtaccggggatttcttaatggcaagaggaattgccaccatctccactgatgcctacgagggtgacgtttacttccgtctctgcgtgaatatcagtctctatgagtgatactcatattttacctactatggtttatcataggtcaatgttatggtactattgaactgatgaggttagggatcatggaatttgttgggattaggtgtcatggaattagatttcgatggtcatttatttatgaattttgcatggatagatttttctgagttgtcggatatgccgctcttcatatgtaaatatttttctttaatataagtattagttgttttagttgcaaaaaaaaaa

SEQ ID NO: 109 - DNA, 814 bp, Pinus radiata
aatatttgtaagagcttccagtacatgttcgatgggttccggggttttgttttcggcagtggccaagaccactctcgtcctcgtcttcgtgcaggccgctgcggggataagcgagacgaatatggtgctctatatgcacgataatttgacgggacgcaacgtgacctcattccctgttgcaggattgaatggttcttcgtctgacccgggaaaatttgggaccgtagtaataatgagcgaccctatcaccaagcagccagaagtcaccgactctgacggaaacaactatctgggtcgggcgcaaggagcttacataaatacgaatccccatactgggatggaatttttaatggttttcgcgatcactttcgagagtatggagtataacggaagcaccctacagattcaaggaatcgagaggttcgatcagcctcagcgtgagtactttgtagttggaggaacagggcagttcagatatgctcgtggctatgtagtttgtaccatggagtatgtttctggcgagaatgctgttcttcgattgaacacaacatttcgtactgattagttattattatacgtcgtactgattcgttattattataagtttcatacctgctttatttctctctttcgtgatctccgtttgtgccttaataaatgaggcccggcgttaaggcacggcgatactttgtctgtgaattgtttggtgtttgtgtgtgctccttgtaagaaaaatgacagcatttgcaaggttctactttggtgtgcttcgcggctttaataaaaatgagtcatcttaactgtaaaaaaaaaa

SEQ ID NO: 110 - DNA, 945 bp, Pinus radiata
gcattcgtcgcacacacttctaattaaaaatattcattcctagatccccatcttctgtatttctgcaatttacatggcaatgccagtgaagcccagtagtagagagcttgtgcatttgtgcattttatggcttctggtatccactgtattgctgcaagtgactgatgggtttgtctggaagaagcgcgaatacgaaaagcctaattggaataaggttttttatttccacgatgtcctttacaatggcaacaacgccgagaacgctacatctgcgattgtggcggctccccaaggcgccaacctcaccagcctcactgataataaccactttggagatctggtagtcttcgacgatcccatcacgctagacaatgatatgcactcccctccggttggcagagctcagggattctacttttatgacatgaagaacaccttcagcgcttggctcggattcacctttgttctcaactctacagagcacagaggcaccatcacattcgctggagcggacccaatacttactaaatacagagatatatcagtggtgggagggaccggggatttcttaatggcacgaggaatcgccaccatctccactgatgcgtacgagggagatgtttatttccgtctccgcgtgaataccactctctatgaatgctataactgcttattgtctgcgagtgccagccatgacaaccaatagaaaatggaagtatctgataacttgattgtaccactcttagattagattatattattggctaggtttaatattagattagattagcccacccatataatcttaaatggctgccgataggccttagctacggtttagggcaggttaaatcttctttttagatgttaagagtttgaaatttgattaatcataaaggttttattaataaaatttattctaaattgagaaatttaaaaaaaaaa

SEQ ID NO: 111 - DNA, 998 bp, Pinus radiata
tcttttgttctccaaagtcgatccgcttcatttgacgaagaaatttttacaatgaagattttcaataatcccctgctgtttgcagtgtgggcgctatctatggtttccgcagcattatcttgtgaccgctgccttcgcaaatccaaagtcgcctctttcgctcgggccaatattaatggcgcatgtggatatgggaactctgcaacaagcctaactgctcgtggagggctggtcatggcaagcgcaagtgccaaaatatacagagacggtgtaggatgcggcgcctgctatcagataagatgcacagatccaggcgtttgcaccaaatctggagtgaaagttttggttacagacttcacaaaaagcactcagacagattttgttctttccgctcgcagtttctcgaaactggcggtagctagcaaagctgcccaatttctcaagatgggaaccgtggatatagactataaacgaatcccctgtgactatggaagccaaaacatgactgtgaaagtagacaaaagcagtaaatatccggactatcttgctgtccagtttttgtatcaaggaggccaaacagacattacagcagttgacattgaccgggtgggatcatcaggttggcagtatatgacccacaaaaacggtgcaatttggggcattcagaatcctcccataggttccctatcgtttcggttattggttacaggcgggtacgatgggagttgggtgtggcctacaagaaatttactgcccgcaatctggaggccaggctctgtttatgattctggagttcagatcacagaaattgcgcaagaaggctgtagtccctgcgaaactggcaactggactgacacacgcacaccttaattaattgtcataatccaattgtttgaggcatagggctgagattgttttctaattggctagcatagtaaaaaaaaaagcagtgagatgtttatatattgttttttccagataaaaaaaaaaaaaaaaaa

SEQ ID NO: 112 - DNA, 1256 bp, Pinus radiata
cggccgcggtgtcatatccattccctgctcttcagtatcagtatcagttgaaatctgttgcagtttttattggtttctctggagagattcgaaccactctcgtcctggcaccatgcatgggattggtttgtagagtgtagcgtactgattatgtgttgtgtgtgcaggaaatggcgtttctatggctggtttcgttgggtctcctttcaatgctccgagctgcgcatggttcaggatggaccagtgctcatgctacgttttacggtggtggtgacgctactggcacaatgggcggtgcttgtggttatggcaatctgtacagccagggctacggtaccaacaccgcggctctgagcactgctttgttcaataatggtttcagttgcggtgcttgctatgaaatccagtgcaacgatgacctgcaatggtgccttcccggttctatcgttgtcactgctactaacttctgcccgcccaacaatgcgcttcccaatgacaacggtggttggtgcaatcctcctctggagcactttgatctctcggagcccgtttttcagcacattgctaagtttcgggctggaatcgtccctgttcaatacagaagggtaccctgtcaaagaaagggtggaattcgtttcaccattaatggtcattcgtacttcaatctggtcctcatcaccaacgttggtggagccggcgacgttgaggctgtttctgtcaaaggcgccaagactggctggcagccaatgtcccggaactggggccaaaattggcagagcaacagttaccttgatgggcagagcctctccttcaaggtcaccaccagtgatgggaaaactgtaacttcctacaatgtcgcttccagcaactggcaatttggccagacttttgcaggggaacagatgaactgattttgggggttttgtttatcaccacattaaccaaccttacaagcgtttacccttctagatgtagcaaggtttttgtccttttgggtgttttttttcttttttcaccttctttggggttattaacggtcttgtgattgtgtaatggatgccgcggtggctgtgatttgctgcccgctcctgagtttatcgttcgtcaatctgaacgacagtgtcttgtttaacgtattctaagttgcagaggtggtctcttgacacccgctctactggggatttatgtaaagccctcttattataaatatatataatgcgacttctatgtcgttgttgttaaaaaaaaaaaaaaaa

SEQ ID NO: 113 - DNA, 1581 bp, Pinus radiata
agtatgcgctctcatattcccttaaattattgttaaagagttccattctccactgctagccagccggagatgatgagttcctgcaaattcttgttttaacaccgcaacattactaacatgtgcttctgcttgctttgctaggtaaaaagaaaaaggctcactgcaggttgactaccgtccatccatcaagttttatggctgctactgatttgggcccctttgcgccccagatttcaagcaaagtgaaaagcagttgatagttattctgtggggatgggatatgatagtataaattccctcctaaagctctcgtctctgcaccaataaatttgggtttgttgttcctttgcgtttcattgctttcttggttagtttatttcgttagtatgaggcggacagttgggcttcaatggccgctggtgcctaatgtctgtgtaaatgtaactgcattttgctttgtattgttgttgttgttttcgtgcaaggaagcagcgttgggtttggaacacactgagcttaatagggatgacttggaatggcgccctgctacagccacctggtatggcagtccagatggcgatggcagcgatggtggggcctgcgggtatggcggccttgtagatcagaagcctctgcgagcgagagtaggggctgtaagccccgttttattcaaagggggagagggctgtggagcgtgctacaaggttaagtgcatggagaaaggcttatgctctgagaaacctgtaactgtggtcattactgatgaatgcccaggaggatactgtgcgttcggtagaacacattttgatctgagtggggctgcgtttggtcgtatggccacaaatggtaaaaccccagcgcttctcaacactggagagctcccagttctttacagacggacattgtgcgaatatccagggaagaatataactttccatgtgaccgaaggctccactgcctattggttctccatactcatcgaatacgaagacggagatggcgatgtgggagccatgcatctaaaacaggcggattcagacgcgtggatggaaatgaatcatgtttggggagccaactggtgtctactgggaggtactccactgaaggcgccattctctgtgcgagtgacaacgctgacgagcaaacgaacgttgtctgcgaggaacgtgattcccgatcactggtatcctaacgccacctacaaagcgcgcctcaatttcgaggactagacccccatggtttgacctcccttgtttcatcattttttattcttttaatatgcgaaggccattcgatgaattcaaggtctgtaagtatcaacggccaagagcttccagacatctctgaaatgtgcaggtggtgtggggatggtaactttagaaactggcatcctgtcaggagaacaaatgtcgtttagtgtatgcatatttattatttattgtacgcctggcggagtgaaacctgacataagcaatgataatctttgtggacaaaagtgtataaaggggtccaaaataataggtattttagtgtaagatttatgaattcattatatgtaaatttattattctaaaaaaaaaa

SEQ ID NO: 114 - DNA, 1291 bp, Pinus radiata
gttcctatttaatttcttcaaccccactccgtctcctccgattcatcccatctgcttctatttcacagaaaatctctgtgcatgattgagttttgattgattgattgtatcgtcacttacatataatttctggagggaaatgggtgccctgggatttttggtggtgggtttgttgttagtaaccacaagagctacaatggcttcaagctggataagtgcgcatgcaactttttatgggggaagtgatgcctctggcacaatgagtggagcttgtgggtatggaaatctatacagccaaggctatggcgccaacacagcagctctgagcacggcccttttcaacaatggcctcagctgtggagcctgctttcaagtcatgtgtaatgacgacccacaatggtgtctgagaggatctgttgtggtcactgctactaacttctgtccacctgggggatggtgcaatcctcctttgcggcacttcgatctctcgaggcctgtgtttttgaagattgctaagtacaaagctggagtagtacccatcttgtacagacgcgtcccttgtcacaaaaagggaggaatccggtttacaatcaatggccattcatacttcaacctagtgcttatcagcaacgtgggaggagccggggacgtccatggcgtttggataaaagggtcaagaactggttggcaaccaatgtcacgcaactggggacaaaattggcaaagcaactcctacctcaatggccagagcctctccttcaaggtcaccaccagcgatggcagaagtgtaacttcgtacaatgtagcttctgtaaattggcagttcggtcagactttcagtggagctcagttccattaaggaatatagttcctctgtggatgcgctgatgctctggacttctgaacttattaactctcgtttattgtcattgatgttgaatgctgagatgggttgcaagtccaaaatccacccgcttcatagaataagtattttttattatcaagatcagtgtgtatggccgactctggcgtcttctaccttcagtaaactcactacccactaagagtgcttccatatagcttcaaatctgaagctaatgtgttcagaggattacatgatacggattgtcctccgggtatccatgtagctttatatgaggatgacgcgttattatcatgtattgtcctgtgcatccaggtggatgaggatgatatatggatatatattatccttggtatgtaattgacttataacatctatctatatattgaagttggatcacaaaaaaaa

SEQ ID NO: 115 - DNA, 1338 bp, Pinus radiata
gctccatagtcctgagcttgcagaccatttttctgcaggccttgaagttttcagttgcccttcgtctctgtcagtctctgcaatgggttttctagcgttcataggactttttgtcttcaatttcctgtcaatggccagatttgcccatggctggacaaatgcccatgccaccttctatggagggggagatgcttctggtacaatgggaggtgcgtgtggttatggcaatctatacagccagggatatggcaccagcactgctgctctgagcactgcactcttcaacaatggtctcagctgcggagcctgctttgcaatccgatgcaacgatgatccacagtggtgccttcccggcgcaattgtggtcactgctaccaacttttgcccacctaacaatgcgctacctaacaatgccggaggttggtgcaatcctcccctccaacatttcgatctctccgagcctgtcttccaacatatcgccaagttcagggcgggcatcgtccccgtaatgtatcaaagggtaccctgccacagatcaggcggaattcggttcaccgtgaacgggcactcgtacttcaatctggtcctcatcactaacgttggcggagcaggggacgtccacgcggtttccataaagggctctaggacagggtggcaaccaatgtcccgcaactggggccagaattggcagagcaacagttacctcaacgggcagagcctctccttcaaggtcaccaccagcgacgggagaactgttacttcctacaatgccgctcccagcaactggcaatttggccagactttcgccggagcgcagatacgttgacatagtaaaaaaacaaaaaaatccttatgtctacttatgtcgcccgtgataactactaaagtatgttgtgtgtgcaaggtacaagtagagagtctttaggtatataaatatgtaaaaaacaagtcgggaacgtggtcagattttgtgtggctgtgacgctcgcgttcatttttattaactgaaagcgaagctgattcttgatccgggatgctgttggatgctcttctcggtgactcctatttagagtatattctatctcgtctctgtggctctgacggttagagcatattgtatgtatcagtatatatgactatggtgtgcttggcttatggcagaggtggaactattgacacccgccctttttcgctgcgacttccaaatatagtatattgcagcgtttcgagtattagacttttccagagggcaagccgttttgtacataccattaactattatatatttttattaatataataatgatctactgtctgtttcaaaaaaaaaaaaaaaaa

SEQ ID NO: 116 - DNA, 1092 bp, Pinus radiata
ccccgttctttctccctgggaagaaatcttgcagcatggccaccagaacaccaaatttcttcctgttttgcagtttgggtttcatgctcatcgttaccgtcccaagtccagtgttaagttgcagcagctgcgtctatcagtctaaactcgcctattacgcttactctggggccgtcaatgttggggcgtgtggatacggatcatttgcagcaaaactctatggtggcaatgtgggagccgctagttccgatctctacaggaatggcgttgggtgtagcgcttgctatcagataagatgcacagaccccaaattatgcaacaagtcagggacaacaatagtggttgcggacttcacacagaacaaccaaacatattttgtagtatcaaggagcacattctcaagcctggcaatcgcagataagggctcccagctcatcaagggtgggattatagatatcgagtataaaagggtcccttgccagtacaaggaccagaatttggtggttagggtggacggaagtagccagtatcctcactatcttgctgtgcaatttctgtaccaaggaggccagacagacatagtttctgtggatgttgctcaggtgggtacttctgggtggcattacatgacacgcaaccatggtgcagtgtgggagatacagaagccaccagggggtgctctccagtttcgattcgtggtaaccagcgggtacgatgggaaatggttgtgggccaaaaaggctgtgcttccctctgactggaaatcagagggtctttatgattctggaattcagatcagtgatgttgctttggaaaattgtaatccatgtaatgaaaataacagtggatgggccgactcatcatggatatatgtatgaatgcaaccaacactcagacgctgtggaatccatggacttgacaatttaacgggcttgtgggtatcaactttgcacacaggtgatcacccctttctatatataataagaaaacacaatatgtattagtggcatgcactggtggaaacactggtaccatttaaccattaaatggaagtgcgtttcggtttagaaaaaaaaaaaaaaaaaaaaaaaa

SEQ ID NO: 117 - DNA, 1326 bp, Pinus radiata
ttcagatatcagttctgatttctattggaattgattccaaccgtaggtattgattaaggggaggtcttcttatccttagcgaccatttatttcatcgtgaaatggcgactgtaaaactggccacaattttcggtttgtggtggatagctagtacagcttatgcactagattatggctggcaatccgcacatgctacgttttacggtggcagcgatgcgtccggcacaatgggcggtgcgtgcggatacggtaatttgtatagccaaggatatggaacgaacactgcagctctgagcacggcgcttttcaacaatggagctacttgcggagcttgctaccaaatgaaatgcaaccagcagtccgaccctcagtggtgtctacccggcactgtgacagttactgctactaacctctgcccccctaactctgctcttcccaacgacaatggaggatggtgcaatccacctctccaacacttcgacatggctcaacctgcttttcaacagattgccatatacagaagtggcattgttccaatcatgttcagaagagtaccatgcgtgaggaaaggtggagttcgattcgcgatcaatgggcactcctacttcaatttggtactcattaccaacgtaggaggtgcaggcgatgtggaggcggtttccatcaaaggttccaacactggttggcaagcaatgtcccgcaactggggacagaattggcagagcaactcctatttgaatgggcagactctctctttccaggtcaccaccagcgatgggagaaccatcacttcctataacgttgcttctgcaaattggcaattcggccagacatttgaaggactgcaattctaacacatttacatctgcatcaattcggtttgtccaagagtaacacagaagaaacgacgccgaggtgatgcgagaatatcacccactttcaagtggttattacttcaaaaatacattaggcagtactcctagtgttgaacgagggatacagagattgccgcccgcttctgatggttgctgctgtacagaattgatatatacttcgcgtatattgttgcgctgacttgggactttgggacgcatatttctcctaaattgagtaaattcaaatgggggattggacggtttcactgctatcgttgatggcaattgctggagattttcatgtcctgcgttgtccacaagcaatgcaggttaattgaatttgctagccgtcctctttcgggcaaatcaattgaaggagttttacgtactaatagatatgggggacaatacaagcatattgagttgtacgatctttagaataaaaaaaaaa

SEQ ID NO: 118 - DNA, 1777 bp, Pinus radiata
gatcagttctgatttctattggaattaattctaacggtagatattaattcagggaaatctacttatccttgagaccatttatttcatcgtgaaatggcgcctgtaaaactggccacaatttttggtttgttgtggatagttggtacagcttatgcactggattatggctggcaatctgcacatgctacgttttacggtggcagcgatgcgtcaggcacaatgggcggtgcgtgcggatacggtaatttgtatagccaaggatatggaacgaacactgcagctctgagcacggcgcttttcaacaatggagctacttgcggagcctgctaccaaatgaaatgcaaccagcagtccgaccctcagtggtgtctaccgggcactgtgacagttactgctactaacctctgcccccctaactgttggaatgttaattccaactgcaggttgcgtgggcagcgacggacgtgggcaacgatggacagcaattcactgcccgcgcggatcagcagtcaacggccaccccgaaaccaccgaagcaaaccacaaaaccagccggtctcatatcgcaccacccttcagcgaaaggtagtttccgtgcaacgagctccgatgcaattgggagccgacaactgtccacccagtgatgctggcatgacatcagccactgacacccatcggaaggtatcactcggttaacttaccccgcccgatatgcgtccgatcaacagtgattgtcttccgccgttcgattgtcaggtaaggtctccgtggtttacactcaccgaagtacatacgcaggcctgttgaaaattaatgttgcgtggaataaggtctgttgaaaattaaatgcagcgtggagaaaagctatgtcccatatcttatgttaaagccccgacatgagtttggtgaagttttagagttttacttagggcaatttaatatgaagcatgggcgaaatattacataagttttttaatatatattttaaacaaaaaaaacgttgaccttttgttatgtgaaaacaaaaactcccacggagattgcagtatgtgttttttttgtttttccacacggtgaaaaaaagggatctgagtccgcagcaccagatatatgaaaaatacatacacggggaatgtaatgtgaatattgcattgcaaacgaggagaagagtgtgtgggctcggggcagtcattgaaagaaaatccacggggattgtaaaaaacatttttatgtaattgcatatgaaaatgaaacagagggtctgcagcacccgtaaaagaacagagagttaattttgtattgcaggggagaaatgcacagaagtgcataaatatttctgggtttgtaatgtaaaaagttttttatgcagcagagtgattttgcttgtaatgtaagaagaaaaattgcacagcagtgcaggagaagacaaagaagtgaaagaagaaaaaccatgggcaagtatgtgaaaccatgaattgtttcacacagcagtgaaaaggtaaatgtgtaaatccctgtaagttttgttttcacacagcagtgaatgtaaatgaaatttttacacagtggtgtaaaatttcataggaggcagagtaatttcttttgtaatgttttggtgaatccctctgagtgaaagaggatgaatatgtctctgtaaattctcaggtgaaaacagagttttggtttaatcttgtttttggtaaatccctcacagcaaagaggatgaatgtatatctgtgaatttattttaatgaatggaaatcttttaaaaaaaaaa

SEQ ID NO: 119 - DNA, 1117 bp, Pinus radiata
gcatgagttctgattcctattcggtataattctcacgccacatatgaattcaggtagaagtctacatagcgaccatttatttggttgtaaaatggcccctgtaaaactggtcacaatgttcagtttcttgtgggtggctggtgcagcttatgcactcgacagtggctggcaatccgcacatgctacgttttacggtggcagcgatgcgtcgggcacaatgggcggtgcgtgcggatacggtaatttgtatagccaaggatatggaaccaatactgcagctctgagcacggcccttttcaacaatggcgctacttgcggagcctgctaccaaatgaaatgcaaccaccactccgaccctcagtggtgtctaccgggcactgtgacagttactgctactaacctctgtccccctaactctgctcttcccaacgacaatggaggatggtgcaatccacctctccaacacttcgacatggctcaacctgcttttcaacatattgccatatacagaagtggcattgttccaatcattttcagaagagtaccatgcgtgaggaaaggcggagttcgattcacgattaatgggcactcctacttcaatttggtgctcattactaatgtaggaggtgcaggcgatgtcgaggcggtttccattaagggttccaacactggctggcaagcaatgtcccgcaattggggacagaattggcagagcaactcttatttgaatgggcaggccctatccttccaagtcaccaccagcgatgggagaaccatcacttcctataacgtcgctcccgcaaattggcaatttggccaaacatttgaaggactgcaattctaactcaatttcgtctccatcaatattaacttgtccattggtaacccagaaggaacgaagaataaggtggtgcgaggaaaccaccctcttttaagtggttattactccgagagtcctttaggcagtatttctagtgttgaagcagggatacgcagattgccgcccgcttctacttgttgctgctctgtaatattgatatacactttgcgtatatttctgcgctgagtcaggatggtgatatattgtatcagtgacatatttctcctaaaaaaaaaa

SEQ ID NO: 120 - DNA, 1076 bp, Pinus radiata
ggttctgatttctattcccactcaattctcgcttcagatatcatttcacgtgaagctagttatcctttagcgaccatttatttcgttttgaaatggcgcctctaaaactggccacaatgttcagtttcttgtggatagctggtacagcttatgcacaagatagtggctggcaatctgcacatgctacgttttatggtggcagcgatgcatcgggcacaatgggtggtgcgtgcgggtacggtaatttgtatagccaaggctatggaacgaacactgcagctctgagcacggcgcttttcaacaatggcgctacttgtggagcctgctacgaaatgaaatgcaacgaccagtctgactctcagtggtgtctacctggcactgtgacagttacagctactaacctctgcccccctaactcggcccttcccaacgacaatggaggatggtgcaatccacctctccagcacttcgacatggcacaacctgcttttcaacagatcgccatatacagaagtggcattgttccaatcatgttcagaagaataccatgcgtgagggaaggtggagttcgattcacgatcaatgggcactcctacttcaatttggtgctcattaccaacgtaggaggcgcaggcgatgtggaggcagtttccatcaaaggttccaacactggttggcaaacaatgtcccgcaactggggacagaattggcagagcaactcctatttgaatgggcagactctctccttccaggtcaccaccagcgatgggagaatcatcacttcctataacgtcgctcctgcaaattggcagttcggccatacatttgaaggactgcaattttaacccattttcttctgcatcaaaactaacctgtccgagagtacagtaggcagtattcctcgtgttgaaccaaggatacgacggttgccgcccatgtctagttgtttctgctgtatagaattgatattcatttactgtatgttgccgcgctgactcgacgcggtgatatattgtatcagtgatatatttctcataaattccgtaaatgggcttttatattttagaaaaaaaaaa

SEQ ID NO: 121 - DNA, 1213 bp, Pinus radiata
gcgattcagatatcagttctgatttctattcgactcaattctagcttcagatatcatttcaggtgaagctagttatcctttagcgaccatttatttcgttttgaaatggcgcctctaaaactggccacaatgttcagtttcttgtggatagctggtacagcttatgcacaagatagtggctggcaatctgcacatgctacgttttatggtggcagcgatgcatcgggcacaatgggcggtgcgtgcgggtacggtaatttgtatagccaaggctatggaacgaacactgcagctctgagcacggcgcttttcaacaatggcgctacttgtggagcctgctacgaaatgaaatgcaacgaccagtctgactctcagtggtgtctacctggcactgtgacagttacagctactaacctctgcccccctaactcggcccttcccaacgacaatggaggatggtgcaatccacctctccagcacttcgacatggcacaacctgcttttcaacagatcgccatatacagaagtggcattgttccaatcatgttcagaagaataccatgcgtgagggaaggtggagttcgattcacgatcaatgggcactcctacttcaatttggtgctcattaccaacgtaggaggcgcaggcgatgtggaggcagtttccatcaaaggttccaacactggttggcaaacaatgtcccgcaactggggacagaattggcagagcaactcctatttgaatgggcagactctctccttccaggtcagcactagcgatgggagaatcatcacttcctataacgtcgctcctgcaaattggcaattcggccaaacatttgaaggagttcaattttaagccatttttatctgcatcaagattaagttgtccaagagtaacgcagaagcaacgaagccgaggtggtgcgagaagatcacccgcttttaagtggttattactctaagagtaaataaggcagtattccctgtgttgaactagtgatacacagattgccgcccgcttctgattgttgctggtgaatagaattgatatgtacatcgtgtgctcacttgggacagtaatgtattgtatttgtggcatatatttcctcaactgcgtatgtgggagcgtacattgtttaactgttaatgccgttggcacctctggatcttttcatgaactttacaaattcattgtctatataaaaaaaaaa

SEQ ID NO: 122 - DNA, 1491 bp, Pinus radiata
aaccagtttctgatcatccctttctccggagaaaaagatgaagagattcaggtgtatgtctccgtgcaagttcagtgcctggcttgttataggagctgtgagtgtgtttttgtgtgtgaaggcgagttgggctctggaagaagaagagctggaatggcaccctgctactgctacctggtatggtagtccagatggagatggaagtgatggtggtgcatgtggatatggcaaccttgtggatgtgaagccatacagaaaacgggtgggtgctgtaagtccagttttgttcaaaggtggagaaggctgtggagcatgctacaaggtgaaatgcacggacgagaggatgtgtgcgaaaagagcagtgacctttgtggtgactgacgagtgcccgggaggaccctgtgcatttggtaaaactcattttgatctgagtgggtctgcttttgggcgaatggcgattgctgacaaaaccacgacgattctcaacagtggagagatcccagttctatatagacgcacactctgcgagtttcccaggaagaacgtaactttccatgtgaacgaagggtctacagcgtactggttctccattctaatcgagtatgaagacggagatggggatgtgggagccgtccatttaagagaggcggattcagatgagtggatggcaatgcagcattcatggggcgccaactggtgtctgttaggagggccaatgaaggcgccattctctctgcgggtcaccacactctccagcaatcgaacattgtctgccagaaatatcattcctcagaactggtaccccacggccagttacaggtcgcgcctcaactttgaccgctgaaatttaatgttgcagttgaagctctcttcctgtcccagctagtcagagagtgtgtgaaaactaatttcaatgctgctcggtgccactgccaactccctgcagttggaaatccgtagcgaatattaatggatataaagtattggtcaatgtctttaaagtcctccggtgtgtacgaatcctctgctactgtgtaaacatatgtcagagaaggttgtgctagatactagtacagcagtaatttgggtttcttttgctaggttgaaaagtaattttgacagaaaataaacgctaagaaattttatggagaatcaagaggatcggccacaaagtggctagtccctctctacgttgtacgtttgtgttaaaaccttaacacaaattacacaaattattagggttctagggtccctctctatgttttagggtttcaaagtatttaaaggctttgtatcatctcgtttgtgttaaaaccttaaattattagggttttagggtctctctctatgttttagggtttgaaaatatttaaaggttttgtatcatctctattttctattttccatggctatatcatatttcgtgatattttttaatcttaatatatggtacagtctttaatgaaatgatcttcattttcaaaaaaaaaa

SEQ ID NO: 123 - DNA, 1475 bp, Pinus radiata
gcactttctccggagaaaaagatgaagagattcaggtgtatgtctccgtgcaagttcagtgcctggcttgttataggagctgtgagtgtgtttttgtgtgtgaaggcgagttgggctctggaagaagaagagctggaatggcaccctgctactgctacctggtatggtagtccagatggagatggaagtgatggtggtgcatgtggatatggcaaccttgtggatgtgaagccatacagaaaacgggtgggtgctgtaagtccagttttgttcaaaggtggagaaggctgtggagcatgctacaaggtgaaatgcacggacgagaggatgtgtgcgaaaagagcagtgacctttgtggtgactgacgagtgcccgggaggaccctgtgcatttggtaaaactcattttgatctgagtgggtctgcttttgggcgaatggcgattgctgacaaaaccacgacgattctcaacagtggagagatcccagttctatatagacgcacactctgcgagtttcccaggaagaacgtaactttccatgtgaacgaagggtctacagcgtactggttctccattctaatcgagtatgaagacggagatggggatgtgggagccgtccatttaagagaggcggattcagatgagtggatggcaatgcagcattcatggggcgccaactggtgtctgttaggagggccaatgaaggcgccattctctctgcgggtcaccacactctccagcaatcgaacattgtctgccagaaatatcattcctcagaactggtaccccacggccagttacaggtcgcgcctcaactttgaccgctgaaatttaatgttgcagttgaagctctcttcctgtcccagctagtcagagagtgtgtgaaaactaatttcaatgctgctcggtgccactgccaactccctgcagttggaaatccgtagcgaatattaatggatataaagtattggtcaatgtctttaaagtcctccggtgtgtacgaatcctctgctactgtgtaaacatatgtcagagaaggttgtgctagatactagtacagcagtaatttgggtttcttttgctaggttgaaaagtaattttgacagaaaataaacgctaagaaattttatggagaatcaagaggatcggccacaaagtggctagtccctctctacgttgtacgtttgtgttaaaaccttaacacaaattacacaaattattagggttctagggtccctctctatgttttagggtttcaaagtatttaaaggctttgtatcatctcgtttgtgttaaaaccttaaattattagggttttagggtctctctctatgttttagggtttgaaaatatttaaaggttttgtatcatctctattttctattttccatggctatatcatatttcgtgatattttttaatcttaatatatggtacagtctttaatgaaatgatcttcattttcaaaaaaaaaa

SEQ ID NO: 124 - DNA, 1165 bp, Pinus radiata
gcagagaataaatccgacgacccaacggcaaaagcagtgggcacagagggcccccgtgtcggagcaacgcacagatttttagttcactgccatgctatatctaacagtatagctggtaaagctgttgatgtttttcttctcttctcaacttcctctccatcaggccacaacatcagtatgcagacgagaaggggatcatgggttgcctatctgttgctgctgctgctgctaaatttgggttggtggaagcaattaataataatgcctacttcagctgcttacgccaacgatggatggaagtacgccttcgcgacgttttacagcgaatctgatgcactaggcaccatggcaggcgcatgtggatttggagatttgtacaggcagggctatggcgtcaacacggcggcactcagcagcgttctttacaatggaggtcaggcatgcggggcttgttttgaactgagatgtgtggaggatcctctttattgccatccgggaacgtcaatcgttgtcacagccacgaatttctgcccgccgaactacggcctgcctggggaggatggcgggtggtgcaatccgcctcgccagcatttcgtattgcctgtcaccgcctttgaaaagattgccatgtggaaaatcggtaccatgaatgtccagtacagaagagttcgatgtgcgaaggtagggggaatgaggttcgccataaacggaaaggactttttcctgacagttctgataagtaatgttgctggagacggagccgttagcggtgtgaaggtcaagggttcgaagacgggatggctgtcgatgggcacaaattggggacagaactggcacgttaatgccgattacaggggccaagccctgtcgttcgaggttaccaccagtgacggcaagactgttacttcttacaacgttgctccctctgactggcagttcggccatacctacaaggggaaacagttcagttaaaacgcgtgctgcgagctttatttttgggtggttgcgggtttcgaactccgaatctattgattcatcggttctaaaagaaccagaatcggctgtggcaaaatctgaaaggagtttgttgtttttcaggatatttgtaattatattttttctaaattaggatcctgtaaaggagaaatgttcatctgaaatgatg

SEQ ID NO: 125 - DNA, 1034 bp, Pinus radiata
gtttcgatgcagtgaagctcttcattttgcagtgacagtgacgttgtttgcaagatgttgacatctgggtttgttttagtagcagtcgcgatcatatttgctaataaatttgtttctgcccatgactacaatggcggatggtattatgctcacgccactttctatggaggagcagatgcttccggaaccatgcagggggcatgtggttacgggaacttatacagtcaaggctatgggaccaacactgctgctctgagcactgttctctttaacagtggggcatcctgtgggtcgtgctttgagataaaatgtgtggatgatccccagtggtgtctgccaggcagcccttctattgtggtcaccgctaccaatttctgtccccccaattacgccctccccaacgataatggcggctggtgcaatcctccccgagaacacttcgacatggcaatgcctgcattcgaacagattggcatatggaaggccggaatcgtgccagtccaatacagaagagtggcgtgtgtgaaggaaggaggaatgaggttcaccattaatggcaactactacttctacctcatcctcgttacaaacgtcggcggcgacggagtggttgcagacgtgaaggtgaaagggtcgaatactgggtggctgcctctgagccggaactgggggcagaactggcaatgcaataccattctcaaggggcaggctctctccttccgagtcacctctagcggtgggcgaacagttacttcttacaatgtggctccctcccactggcaattcggacagacctttgaaggaaatcaattctagaagtactaatacggccgggactgtatcaccagatctcagattcctagcaagctgcaacgaaaagatttgtatagatagttggaagggcaggggtgcgttcaatgcgaccacccgctgaaagagagtcccggcaggcatatagatagatagataaaattagatggtgtgtgtataaagtttaaactattataataaagatatatgctataaaaaaaaaa

SEQ ID NO: 126 - DNA, 1048 bp, Pinus radiata
caattcaagcatcatggccactcaaacaccagttgtcttcgtcctttattgcattttgggtgtaaatcttctcatcgtgttcccaagtttagcgttaggttgcaccagctgtgtccatcaatctaaactagcctattatgcttacccaggagcagttgatgttggcgcctgcggatatggatcatttgcagaaactctctatggcgggaatgtaggaggatccagtcgtgatctgtacagaaatggcgttgcgtgtggcgcatgctatcagatgagatgcacagactccaaattatgcaccaagtcagggactacaatagtggttacggacttcacagagagcagccaaacagattttgttgtaacccgcagcactttctcaagcatggcactaccagatcacggggaccagcttcttaaggccgggattatagatatcgaatataaaagggtcccttgccagtacaagaaccagaatatgtcggtgaaggtggacaaactgagccggtatcctaactatcttgctgtgcaatttctgtaccaaggaggccagacagacatagtttctgtggatgtggagcaggtgggttcttctgagaagcatgacttgaagcgaaactatggcgcagtttgggacatagagaatccgccagaaggtgctctgcagtttggatttgtgatagtcagcgggtacaatgggaaaagggtgtggccgacaaagtctgtgcttccctctgactggaaggtagggggtgtttatgattctggacttcaaaccaatgacgtttctttggagaagtgtagtccgtgtgatcacaacgaccgtggatggggcgactcacgaataccatgaacagacgtataaaaattgtcaactgcgatcgtacatggttgaatccatggattcaagaagctaatggggaaacccagatcgctttgactttgaatcatcgttgtagagaagtcatcatcaccactttgtatatgtaataagtggtataaataaagtttcgcaggttggcgtaaaaaaaaaaaaaaaaaaaaaaaa

SEQ ID NO: 127 - DNA, 1265 bp, Pinus radiata
gcccccgctttcctctatcatcattattgcttctgatctccttgattttcagggtagccttcttaatttagactgaatcactgcggtggttcttatagcagcgtaatatgataagcatgacatctatggtacgggtgaagagcgttgcattggtctctatgtcaacaattatctggttgataactcgagctcatggatatggagactgggagtcagctcatgcaactttctatggtggcagtgatgcttctggcacaatgggaggggcgtgtgggtacggtaatcttaacagccaaggctatggaaccaacactgctgctttgagcactgcgcttttcaacgatggactcagctgcggagcctgctatgaaatgcaatgcaatgacgatgcccaatggtgtttgcccgggactgtcacggttacggctactaacttctgcccgccaaacaacgctctccccaacgacaacggtggatggtgcaacccaccgctgcagcatttcgatatggcggagcccgcttttcagcagatcgcgaagtacaagggggggatcgtccctatcctctacagaagggtcccctgcgtgaggaagggaggaattcgtttcaccgtgaatggccactcatacttcaacctggtgctcatcacaaatgttggaggacctggagatgtccacgccgtttccataaaagggtcaaggactggttggcagcccatgtcacgcaactggggacagaactggcaaagtaattcctacctcaatggacagagcctttcgttccaagtgaccaccagcgatggtaagacatttgtttcatataacgccgctccttcaagctggcaattcggccagacattcgaaggatgccaagtctaaggatagcccaagtcgattgactctatatggccatcaactgggatgatgtggtgattcaaacagtcgacaccctctccccctcgtaatcatttttaagtgattcatgaattctactttatatatcgattgattgttattaatgttgatgagtgtgtactagtgtagtcctcactctgcttggttacagctctcactgcaaccttactgtgttaacagaactttgaaagacttgttctgcttaatgcaatttctgcttatatcggcgtaccaaaacggctatgtatcgcctttaagattatattcaaaacaatgtgaagtttgtggctatataagaccaggacttgaacatttagtttattccatccaccccttcaggtaaaaaaaaaa

SEQ ID NO: 128 - DNA, 971 bp, Pinus radiata
cgccccccccttcaggcttcagatctccctgattctcagactagcccttttaacttagagttactgctctaagtagttccagtggtggttcttattgtagcttaatatgagatcgatggaactggtaaagagtattgcattggcgtcattgttaacattcatctggttattaactggagctcatggatatggaggctgggagtctgcccatgccacattctacggtggcagtgatgcttccgggacaatgggaggggcttgtggatatggtaatctttacagccaaggctatggaacgaatactgctgctttaagcactgcccttttcaacgacggactcagctgcggggcctgctatgaaatgcgatgcaatgacgatccccaatggtgtttgccggggactgtcacggttacggctaccaacttctgcccgccgaacaacgctctccccaacgacaacggtggatggtgcaacccaccgctgcagcatttcgatatggcggagcccgcttttctgaagatcgcgaagtacaggggtgggatcgtccccatcctctacacaagggtcccctgcttgaggaagggtggaattcgtttcaccgtgaatggccactcatacttcaacctcgtgctcatcaccaatgttggaggtgctggagatgtccacgccgtttccataaaagggtcaaggagtggttggcagcccatgtcacgcaactggggacagaactggcaaagcaattcgtacctcaacggacagagcctttcgttccaggtcacaaccagcgatggccggacagttgtttcaaataatgttgctccctcaaactggcaattcggccagactttcgaaggaagccaggtctaaggataagcccgaagtcgattgtagagtctgtatagccatttgaattaatgaatgtgtcattggggatgacgtggtgactcgtactgtcgacacccttttcttg

SEQ ID NO: 129 - DNA, 1294 bp, Pinus radiata
agacacggctttgcatccaagcattagcgcctgcaacttttctgggctgagaaagctgagtaaacccattttatacaatggccatcgggatcatagagcgccaggcagctagtcttgtgaagggatttgttattgcattggtttttagtatatcagttgcagagggcagtgggtatactagttctggatggaccagcggccatgctacattctatggaggcagcgatgcctctggcaccatgggaggcgcttgtggatatggtgatctatacagcactggctatggcactaaaactgcagctctgagcaccgctctgtttaacagtggggccacttgtggggcatgcttccagatacagtgtgatataagcaaggatccacagtggtgtttgccagggccaaaatcgataacaatcactgcaacaaatttctgccctcctaattacgctcttcccagcaacgacgggggttggtgtaatcctcccctcatgcatttcgacatggcccaacctgcgtgggagcagatcgccatttacagcggagggattgtgcccgttcaattcagaagagtgccgtgcacacctgttggaggtgttcgattcaccattaatggccgttcgtacttcgagcttgtcctgctctcgaatgtgggcggagcaggggatattagcgcggtgtcaatcaagggttcgaacactggatggcaacccatgtccaggaactggggagtcaactggcagagcaactcgtacctcagtgggcagagcctgtccttccaagtgaccaccagtgatggcaattccattaccttctacaacgttgccccttcgaattggcaattcggacagacttttgcaacctcgcagcagttcaattgatttcgcaatcctatgttttatttcactatatttcgtatttgttttatgaccagtaccagaattctatataagttatcctaaatcagtaccaaaacttctgaaaataactctgaatacattccgggtgcttgaatggcggcagcaggggcgagcttgatcatgaatcttcgttgcagcagcccgctgttctacgtattgcagttgtcaccgcctcagccaaaagtcggtggctgaacaatcaaacagtgcagactgcaactttgtataatctggttatggaccttgtcatccctctgtaaagagtgcgatatattctatagatagataaatatccatgttgctgatattcttcttctcggctctgtgagcccaaccgtgtcccaatgctctgtagaatcgtaaagggtactggccat

SEQ ID NO: 130 - DNA, 1025 bp, Pinus radiata
taattttgcagtacttttgcaagatgcagagtccattaaagtctagagttcgatatgttttaatggtactggccattatctttgctcagacgctggctgctgctgatgattgcgatggcgattggaactctgctcatgccaccctctatggaggaggagatgctgcaggaatcatggctggtgcttgtgggtacgggaatttatacagtcaaggatatgggaccaacactgctgcactcagcgctattctgttcgacagtggggcggcctgcggcgcttgctttgagataaagtgtgttgatgattcgcaatggtgtctgcctggcagcccgtctgttgtgatcacggctactaatttctgcccgcccaattacgccctgtccaacgacaatggcgggtggtgcaatcctcctcgcgagcatttcgacatggcgatgcccgcttttgaacagatcgccatctggaaggctggaatcgtgccagtccaatacagaagagtccgttgcgccaaaggaggaggaatacggttcaccattcatggaaatcgttacttctatctcatcctgattacaaatgtgggcggagacggggacgttgcagaggtgatggtgaaggggtcgaacactgactggctgccactgacgcggaattggggacagaactggcagtccaataccaatctccaggggcaggctctatcatttcaggttagctccagcagtggccacaccattacttcatataacgtggctccttctgactggcaattcggacagaccttccaaggaaatcaattctagatacataggataaacttcattactgtgaaattttcctggcctctgcgatatccttcatagtatagaaatacagaaaagcaatcgcagcagaggcgtgctcagcacagccacctgcacatatcaatactctgggtaacgaaaagtatgttatgtaatttatggaccgcaattttgtgttttattaaatgaattacatatcgcacagacaatttgggaaaaaaaaaa

SEQ ID NO: 131 - DNA, 3798 bp, Pinus radiata
gcaacctcacacctccccagcggcgaccgttgtgccgtgcagacttttgtttgcgtcctctctttgacgatcaagtcaatacactctttaccggcttcggccataccacaatcttttcaggttatatttgtcgtttaatactagcataatgttttccaccaagttctttgctgcggcggcagccaccttctctctaatccgcttttctacggctgtttatgacccttcatcgcagaggaatttggctatgtactggggttccggatcggatcaactagatttagcacacttctgtgacgagacgaacgtcgacatcattcctattggtttcatcaacttcttcccaccgcaagcgaacggtttggtggcagagactttcggggaccaatgttgggatggaaactacacaggaccaggttacgatggaaccaacaacccaaacgacaacttcttgtatgagcaatgtccaaaccttcaacgcgatttgtattactgccagcaaaacaccaacaagaagatcctcctctcgcttggaggtgctgttggtaactactacttgaacggaccttctgatggagaatacttggccgaattcttgtggggtgcttacggaccatacaatgaatcatggaccggtgtccgacctcttgatcgtggatactacaacacaaacctcaccgaacacatcgatttcgatggttttgatttcgacatcgagcaaacgacccctgatcagcaagccggttacattgcctgcatcaagcgacttcgacaactgttcatagagcacaaagctgtgaacccatgctcaaaggactacatcatctccggtgctcctcaatgtccccttgatgagccatacatgagcaccgccatcgccggcgcccaattcgacgtcctctggattcaattctacaacaacggcgccaacggctgtacagcacgtaactacaccgacagcaaggcccttggaaagacatctggattcaactacgattcatgggtcaccaaagtcaacggaggtgctagtgccggagcgaagctttacattggtctccttgctggacaggctgcgtcggaattctcgcccaatgattacatagatggaccagctattcagactttagttagccagtatcactcgcatcctcagtttggaggtatcatgctttatgaggctacggttgcggagaacaatgctcaattctacaacactgtgaagggcatcttgaacgacaccgctctcgccgggactgtcacctcttctgccaaggtctgcagttctactacctcgaccagctccaagacttcttccacaagcacatcgacgacctcgacatcctctaaggtcaccactacgtcgtcgtcgacctcgtctaaggcaagcaccacgagcagctcctcatcaaccagctcttcgtcatctaccagctcaaccagctcatctaagactagctcttccagcagcagctctagctcaacgaagacttctaccagctcaagtgtctcatcgacctcgacaacttccagctcttcttccagctctagtagcagctctttatcttcaagcagctcttccagctcgacgagtgcttacccaaccaccagctccagcagcgtgatctcctccaccactagcgcttcaagcacatcctcatcaagcagctccagctctgagatttcctcatcaacaagcgtctcatcgacgtcctcggagacaccaacatccaccccaacacccaccactgtcccatcagtcggctcatgcacctacctgggctgctacaccgaagccaccacaacccgcgctctctccggcgcagtgtacgacaactacaccctaatgtccgtcgagatctgcgctggcttttgtaccggatttacctatttcggtgttgagtatggtggagagtgttattgcggtaatgagtttggtgagggtagtgttgtttcgccaccgattgactgcagcatgacttgtgccggtacgccgacggaactttgtggtgcgggagatagattggatgtttattcttgtgctgggagtgcgacgacgacctcttcgagcgttagcggttcttcgacgagctcgattgagagcagcacgagctcgagtgtctctatttcgagctcatcgagcgttgtttcgacctcaagcagcagtgttgtttcatcgacatcttctgaggttacaccaaccacgagctcgacttcctcgtccgtttcatcgacctcaagcctctcatccacatcagtgtacagcgactcgagcagctcggtgacctcaacatcaacttcaagcctttcgagctccagctccgttagcgagaccctgacatccacctcatcaagctcgatctacagcccaacaatcacctcgacagcatacactaactccagctccgctatcgttaccccaacatcaagcctctacacgaactccagctcagtgatcaccaccagctcttcatcttcttcaagcaagtccgtttgcacaagaaagacacacacgagcagtggaagcgtgtcaatcaccagcagctactcagtctcaggaaccgccacatcgatctcaagctacagtgtctcttccggaagctcctcatcatctgcatcaggaattattagcacaccctcatcctcgttgagcggatccgctacttcttccgcccaaggaacagcgacctctgcctcaacaacccaatacacaacctcaaccgtctacaccacctctgtccacacgatcaccagctgtgcagcaaccgtaacgaactgcccagctcgctccaccgtgctgacaacagagacaattgcactctacactaccgtgtgccccgtgaccgctaccgagactggcaagggtgtcccaactacctcttctcctgtcaagccaacatcctcaggatcaggatccggagagacgacttcgtatacgacatctaccgtctacgcgacgagcgtatacacaatcacctcctgtgccccaacagtcacgaactgccctgcgagaattggaagcgtgacgacggagactattgctctttacaccaccgtgtgccccgtcaccgcaaccgagactggaaaggttgctccatcttccacaccctctgcctcgtctcctgttcttccaggaaagggcggaaagagctcctcatccgctgctggctacccagtgtcaggcaccgagagcgtgaagcacaccaccatcagctccacgacaacaagctacgtgaccgtcaaggtcgtcaaatcgacagccactgttgtcgctatcccatcttcgagctcaacagcaggaggagtgacgactgctccttacccaaccggaagtggttcagctacggtcggaaagcctttcggcaccgctggaccatccgtgagccttgttgttggaaaagtcagctcgagctcaaccagcacgaatgctggagttgctaccagctcaagctctcctgttccgtcacagttcactggtgctgcatccaatgtccgaagtggaatgggtgctttggctgcggtggttgttggtgtcgttgcgttgatgatgtaaggggaaagagaaaattagggtggaaggaaggagatgatgtttcttttgtcttgtcattgggaggttattgcatttgaatactcatggcaagggtttggtgtacttgtggttttgattttgatttctgagcgcttggcttgaagggtggaagtggaggagcgtgaataggagaaaggagaaaagaaagaaaaaggatatgtatgtatgtatgattctctgtatgcatatatatgatcgcaaaaaaaaaa

SEQ ID NO: 132 - DNA, 1567 bp, Eucalyptus grandis
ggagcagcagtccctgtagctttctctctctagccttctctctctctagaaaagccggatggcgatggcgggctcgacgggccgccgccagcagcagctgctcctcctcgcgctcgcgctctcctccctcgccgcgatcgcctccgccgccgtcctcttcgaagagcgcttcgaggatggatgggagactcgatgggttaaatctgattggaagaaagatgagaacatggccggagagtggaactatacgtctggtaaatggaatggagattctgatgacaaaggtatccaaacaagtgaagactataggttctatgccatatcagctgagtaccccgaattcagcaacaaggacaagactctagtcttccagttttctgtaaaacatgaacagaaacttgactgtggtggtgggtacatgaagctactcagtggggacgtcgatcagaaaaagtttggtggcgacaccccatacagcatcatgtttggaccggatatctgtggctacagtaccaagaaagttcatgccattctcacttataatggaactaatcaactgatcaaaaaggatgttccttgtgagacagatcaacttactcatgtttacacttttgtcctccgtcccgatgctacctatactatcttgattgataatgttgagaaacaaactggtagcttgtactctgactgggatcttctcccaccaaagcaaatcaaggatcccgaggcgaagaaacctgaagactgggacgacaaagagtacattcctgatcctgaagacaagaagccagaggggtatgatgacatcccgaaagaaataccagattcagatgccaagaagcctgaagactgggatgatgaggaggatggtgagtggactgccccaaccattgccaaccctgaatacaagggtccatggaatccaaagaaaattaagaatcccaactaccaggggaagtggaaggcaccaatgattgacaacccagacttcaaggatgacccagagctctatgttttccccaagttgaagtatgttgggattgaactatggcaggtcaaatctggaaccttgttcgataatgtcttgatatgtgatgatcctgagtatgccaagaaggttgctgaagagacatggggcaagaacaaggatgctgagaaggcagcatttgacgaggctgaaaagaaaagagaggaagaggaagccaaggatgagccggtagattctgacattgaggatgaagatgatgatgctgatgccgatgatgctgaagacgattctgattccgtaattaaagcagaagcagatgagagtgctgagtctgctgactccaaggacgaagtaaaggatgagttgtagaaagaggcagagcaataaagctgatcggttgggttcgacataagcttggcgccttcaaaatttttctttttctatctttacaatatagatgtaggacatttctttagagagggagagaactgtaggaagggctgatcccaagacttttgagtgcctgatttcatctatatccattgactgatttgagttttcaaaaaaaaaaaaaaaaaa

SEQ ID NO: 133 - DNA, 2239 bp, Eucalyptus grandis
ggatcaaatcctctccaaacttcgatccgatcgcgtcctccagattccgatcgttcgtcgctcgtcacggtgctgggatgatggaggggaggcggattcgcctgctggcccgggcgctgacggtgttgctgctcagcttccagatctgcgcttcggacgtgatctttcacgaatcgttcgacgagtctttcgagggacggtgggtcgtgtccgagaaggaagaataccaaggtgtgtggaagcactccaaaagtgagggacatgatgattatggccttcttgtcagtgagaaggcaaggaagtacgctattgtgaaggagcttgatgatgttgtgagtcttaaggacggaactgtagttctacagtatgaagtccggctccaggacgggcttgaatgtggcggtgcatacctgaagtacctccgtccacaggatgctggatggaaagtcaaggaatttgataatgagtctccatacactataatgtttgggccggataaatgtggtgctaccaacaaagtgcatttcattttcaagcacaaaaatcccaaaactggggagtatgttgaacatcatctcaagcaccctgcatctgtgccctatgacaaactctctcatgtctacactgctgtattgaagcctgataatgaactgaggatattgatagatggtgaggaaaagaagaaggcaaatttcctctcggctgaagactttgagccagcactcatcccacccaagacaattcccgacccagatgataagaagccagaggattgggatgagcgagcgaagatcccagattctgatgcagtgaagccagatgattgggatgaggatgccccgatggaaattgtagatgaagatgcagtgaagcctgaaggttggttggatgatgagcccgaagagattgatgaccctgaagctacaaagcctgaggattgggatgacgaggaagatggtgaatgggaagctcccaaaatcgacaaccccaagtgcgagactgcacccggttgcggtgagtggaagaggccaacaaaaagcaaccctgcgtacaaagggaagtggcatgctcctctaattgataacccgaactataagggcatctggaagcctcaagagatcccgaatcctgactactttgagcttgaaagacccaactttgagccgatagctgcaattggtattgagatttggaccatgcaagatggaatcttgtttgacaatgtcttgatcgcaagtgatgagaaggtggcagagtcatacagggaaacagcatggaaacccaagttcgaagttgaaaaggagaagcaaaaggaagaggataaagccactggttctgatggactctcagccatacataaaaaggtattcgatgtcctttacaaggtggcggatgtttctttcctggagccatacaaacctaagatcttggaactcatcgagaaagctgaggaaaaaccaaatatagcaattggtgtgcttgggtctattgtggttgtcatcctgacggttttcttcaaaatcctctttggcggcaagaaaccagtggctaatgtaccggagccacggagggaagcagctgccgagacttccaacaaccaaggtagccaaggggacaaggaagacgaggatgagaaggaagatgcaggtgatgccgctgctgctgcggcacctcgtaagaggcctaacagaagggaaatatagagtcagcacgggaatatagttggatgtctatcctgtgtctccgaatggttcccaccgttgtcactgattattcaagtctctttaggttttcggagaattgcttatcgagcttttttcaggcctctttggttgttatagttattttaggagtttgataaaattttgacgatgagaaacattgaaactgtattatttctgatctaattgtccttcatgcggttgtacttttcctcgaggcctctcaattgctcgtattcgcgtattgcatgggatgctcatgattggcgatcttgaatgtaggttagaaatggctctgatggcccactctctttcatatgttgtgtttgaaaccgttgactgtgttttatgggactatatttcgtgcatctgaaagtttacctttcggagggaatttgcatctgaaagttgatgagtggaattttggtaagtgcttgtttcgtgatggagatttgggtttggggctccttgtacgaaacgtacgattttatggttataataggattttaagaaaaaaa

SEQ ID NO: 134 - DNA, 1968 bp, Eucalyptus grandis
aacgccgccgccgccgtctcttcccgtcgcttccccgccgccgattccaaatcgagcgtccctcgaccgttggcgatggagggaagccggatccctcggctcgtgccggcgttggcgctggtgctgattagcttcgcctttctccagatccgcgcgtctgatgtgatcttctacgattcgtttgaccagccgttcgtgggaaggtgggtggtgtctgtgaaggatgactacacaggtgaatggaagcactccaaaagtgagggacatgatgattacggtcttcttgtcagtgagaaagcaaggaaatatgcaattgtgaaagaactcgatgagattgtgagtcttaaggatgggacaattgccctgcaatatgaagttcgactccagaatgggctcgagtgtggtggtgcatacttgaagtatctccgacctcaggatgctggatggaaagtcaaggaatttgataatgattctccatatactatcatgttcggaccagacaaatgtggttcaaccaacaaggtgcatttcattttcaagcacaaaaaccccaaaactggagagtatgtggaacaccatctcaagttcccgccatctgtgccctatgacaaactctctcatgtctacactgctgtattgaagcccgataatgaactgaggatattgatagatggtgaggagaagaagaaggcaaatttcctctctgctgaagactttgagccgccactcatcccacctaagacgattcctgacccagatgataagaagccagaggattgggatgagcaagagaagatcccagatcctgatgcagtgaagcctgatgattgggatgaggatgccccgatggaaattgtagatgaagatgcagtgaagcctgaagggtggttggatgacgagcccgaggagattgatgatcctgaagctacaaagcctgaggattgggatgatgaggaagatggtgaatgggaggctcccaaaattgacaaccccaagtgtgagttggcacctgggtgtggtgagtggaagaggcctatgaaaaggaaccctgcatataaagggaagtggcatgctcctctcattgataacccgaactacaagggcatttggaaacctcaagagatcccaaatcctgattactttgagcttgagagacctcagtttgatcctattgctgcaattggcattgagatttggacaatgcaagatggaattttgtttgacaatatactaattgcaagtgacgagaaggtagcagagacatatagggaaacaacatggaaacccaagtttgaagttgaaaaggagaagcagaaggaggaggataaagacagcgattccccgggtctctcggctgtccataagaaagcttttgacgtcctctacatgatagctgatgtacctttcctggatccatacaaacctaagatcttggatcttattgagaaggcagagaaacagccgaatattacgattggcgtactggtttccattgtggtcataattttgacattattcttcaagatcctttttggtgggaaaaaaccagcggttaatgtgccagagccacgaagtgaagcggctccggagacttccgacggtccaggtagcagtggagacaaggaagacgaggacgaggacgaggacgaggacgagaaggaagagacagctgctgctcctcgtaggagatctatccgaagggaagcttaagcgagtcacctgtgaagggctttctgtgtcattactccaaattttgagcagtagtatatgttgccgggcatcgatcaaagttgtggttagatgatttttcgattctgtcatgggtgaaatctgaatactatgtagaagtctaggttatcctggattacgtctcgaaatgttgtgttgatgggattttgtagcagatatttagttttatttggactggcaagtctttaaaggaaagaaaacgttgaagtaaaaaaaaaa

SEQ ID NO: 135 - DNA, 1349 bp, Eucalyptus grandis
cccacgtctgcgcatttgtttgcgagagagagatccacacataaccaatgaaggccttattgttcctctcctttgtcctcttcgttgctgttgccactgcaactgtgcacttccaggaagagtttgacgccggatgggaaaagcgctgggtttattcgactgctgatgacgcttctggttcggcagggaagttcacggctacccccgggcagtactatggcgatgctcaaaaggatagtggtgtgcagacaagcaccgacgccaggttttacaaagcgtcagcgcagttcccaaagttcagcaacaaggacaagcctctcgtgctgcaatattccgttaagaacgagcaggagctcgattgcggtggtgcctacttgaagctttctccccctggggtcgaccagaagtctttgactggcgaaacaccctacaacatcatgttcggtcctgatgtgtgtggctattcgaccaggcgtgttcacttcatcttcaactacaagggtaccaaccatctgatcaagaagaccgttgctccttcctctgacaagttgacacacttgtacactgctatcatcaaccccgaccagacctacgagatcaggattgacaatgagaagaaggagtcaggcaagcttgttgatgactgggacttcctgccaccaaaagagatcaacgatcccagcatcagcaaacccgctgattgggttgaggagaaggagattcctgatcctgaagacaagaagcctgaaggttatgacgatatcccaaaggaaatccctgatcccgatgccaagaagcctgaagattgggattctgaacttgatggcgagtgggaaccccccaccatccctaaccccgagtacaagggcgaatggcatcccaagttgatccctaacccggcctacaaaggcccttgggttcatcctcagatccccaatcctgactatcattatgatgacagcatctatgctttcgagcacgagtttgtcgctttcgagatctggcaggtgaagtccggcaccatcttcgatcacattttggtgacggactcgcttgaggaggccgaagcatttgccactggccatttcgctgcccagcagaaggcagaaaaggctatgtatgacaaacaagaggaggagaaacaggagaaggaaaaggccgagcgtgaggctgagaagcaaaagcttgaggaggaggggaagaaggaagatgatgacgaagatgaggatgaggaagaggaggaggatgagggcaagggccactcacacgacgagctttaaagacggacagagagtgacctgttgttgccgtgcgcccaaaaattttcgtggccaagcccaaaaaaaaaa

SEQ ID NO: 136 - DNA, 1601 bp, Eucalyptus grandis
aagcaagcagcaagcaagtcccgagctttctccccatcaatggcggggaccgagcgcaggcagcagctcctatttctcctcccgacgtcgccgctctgcctcgccctcctcctcctcctctcctccctcgcccgcctcgccctgtccgaggtcatcttcgaggagcgcttcctggacggatggaagagacgttgggtggtgtccgactggaagaagagcgaagggaaggctgggacgttcaagtacacggccggaaagtggcccggcgatcccgacgacaaaggtatccagactattaaagatgcggcgcactctgccatatctgcgaagctgccagagttcagcaacaagaacaggactttggttctccaatactctattaagtttgagcaagagattgagtgcggtggtggttacataaagcttctctctggatttgtcaatcaaaagaagtttggcggggatactccttacagcctaatgtttggaccagacatatgtggtacccagacaaagaaactccatgtcattctttcctaccaagggcaaaattaccccatcaagaaggagttggaatgcgaaacgggcaagttgactcatttctacacattcatcctcaggccagatgctacttatagcattttggttgataatcgagaaagggattcaggaagcatgtacacagactgggatatccttcctccacggagaatcaaagatgtcaatgctaaaaagcctgcagactgggatgacagagaatacattgaagaccctaatgaagtcaaacccgagggatatgattcaattccttctgagatccctgatccaaaagctaaagagcctgataattgggatgaagaagcggatggagtgtggaaaccaccaaaagtaccaaatcctgcctttaaaggaccatggaagcggaagaaaataaagaatcccaattataagggaaaatggaagatcccttggatcaacaatccagagtttgaggatgaccccgacctttatgtgatgaagccaatacaatatgtaggcattgaggtttggcaggtaaaggcaggtgcaatattcgacaatgtcttgatttgtgatgatccagaatatgcaaagcaagtggtggaggaagtattcgccaatcgagaggctgaaaaggaggcctttgaagaagcagaaaaagtgaggaaagcacaagaagaagaggaagctcgaagagcaagggaggaaggcgaaaggagacgacgtgagaggggttatgatcgacgatatcgagatagatacagagataaatatagaaggcatgatcgccgcgactacatggatgattatcatgacgagctttgaagctgtgacaagcccatcttcaggggtaatgagggaagttttggcaccaccatccacaccctcatctggaaatttctgtgtttcaactctttgtaacactatagttttgattcaagctgtagctgtaacatgcaacataatgggctgttcctgaacattgtaatgagttcccccaattatttctgcattgccatataactctcgttccaatcgaagctcagacgtcaatctgggacttctgaatttcaaaaaaaaaa

SEQ ID NO: 137 - DNA, 2904 bp, Eucalyptus grandis
cagaccccggatacccacgtgtatatatacccgtctcccgtcgtcagcaggggtggaggattcttgggtttctgctctgttcgtcgatcggcttgagggaaggttcgaaggtgactgaaactcggcgtgttctgtcatggcggctccgaaactgggtcgaatcccgagcatcagggaccgggtcgaggacactctcgccgctcacaggaacgaactcgtctctcttctctccaggtatgtggctcaggggaaggggattctgcagccgcatcatttgctggacgagctcgagaacatcatcagcgaggacgaagggaagagctctctcagcgatggccccttcagtgaggtcttgaaatcagcacaggaagccatagttttgcctcctttcgtggctatagcagttcgtccaaggcctggtgtctgggaatatgtccgtgttaatgtccatgaactgagtgtagagcaactgactgtttcagagtatctgggattcaaggaagaacttgtggatggcaagtctgaagacagttttgttcttgagcttgattttgagccattcaatgcatcttttccccgcccaaatcggtcttcatccattggaaatggtgttcaatttctcaatcgtcatctttcgtccattatgttccgcaacaaagactgtttggagccattacttaattttcttcgagcacacaagtataaaggccatacactgatgctgaatgatagaataccaagcatatcgaggcttcagtctgctttggctaaagcagaagaatatctttcgaagctgccaactgatacaccatactctgaatttgaatatatgttacaaggtttgggatttgagagagggtggggtgatactgcagagagggtactagaaatgattcatctcctattggatatactccaggctcctgatccctctactctagaaacatttcttgggaggatacctatggtgtttaacgttgtcattttgtctccacatggatactttgggcaagcaaatgtgttgggtttacctgacaccggtgggcaggttgtttacatactggatcaagttcgtgccttggagaatgaaatgttactgaggatacagaagcaggggctggatatagctcccaaaatccttattgttactaggctaatacctgattcaaagggaaccacctgtaatcagcggcttgaaagagttagtggaacagaacatagtcatatcttacgagttcctttcagatctgatcaaggaattctgcgtaaatggatctctcggtttgatgtgtggccttatctggagacgtttgccctggatgcagcacatgaaattacagcggagttacaaggctttcctgattttataattgggaactatagtgatggtaatctggttgcttcattattggcttataaaatgggagtcacacagtgcaccatagcacatgctttggagaagacaaaatatccggactctgacatatattggaaaaagtttgatgagaagtaccacttttcatgtcaatttactgctgacttactagccatgaataatgcagactttatcatcaccagcacataccaagagatagcaggaacgaaaaataccgttgggcagtatgagagccacactgccttcactcttccagggctgtacagagttgttcatgggattgatgtttttgatccaaagttcaacattgtctcccctggggcagatatgtgcatctatttcccctactctgaaaagcagaagagactcacagctttgcatggatcaatagaaaagctgctatatgatcctgaacaaaatgatgagcacataggatcattgtctgatcggtccaagcccatgatcttttccatggcaaggctggacaaagtgaagaatatgacagggctggttgaatgctatgctaagaattcaaaattgagggaactagcaaatcttgtagtggtggctggttacattgatgtgaagaagtcaaaggacagagaagagatagcagaaatcgaaaagatgcatgaactgatgaaggaatacaatttggatggtcaatttcgttggatggcagcccaaacaaatcgggcacgtaatggagagctttaccgctatatagcagacacaaaaggtgtttttgttcagccggctttttatgaagcttttggacttacagttgttgaggctatgacgtgcggccttccaacatttgccacttgtcatggtggtccggcagagataattgaacatggtgtatcaggatatcatattgatccatatcatcctgaccaggctgctaccctactggcagatttctttgagcaaagtaaaagggaccccaatcactggactaaaatctctgctgctggacttcagaggatctatgaaaggtacacctggaagatttattcagagaggctgatgacactggcaggggtttatggcttctggaagtatgtttcaaagctcgagaggcgtgagacccggcgatatcttgagatgttttacattcttaaattccgggaattggtgaaaactgttcccgtggcagccgacgagccccattaatctggtggcatcaccgaactcaagggggttgtcacccgggggcattcgccatgtaaatatttccgtctttcactccaatgcagaagcatgagcattccgtattgaataattgagggccagagttcatttgcgctcttgatatgatgatttccataaaataattctgcagcgaggttgtcaccatggtcacgagcgaagaatggttgatggtgcggttgtcttagtctcgtgacagtaatgtatatgcatcatgagttccaaacctaagatgctgaattgccggtatcttaaggtcaaatataaaatgacctctggattattgaaaaaaaaaa

SEQ ID NO: 138 - DNA, 2852 bp, Eucalyptus grandis
gcactggcagagctccacgagtccagtcccgtccactacttagtcccctcgccctccctcgtcactcggcgctttacccggttcgcgctctcccacgcactctgcttccagaccccggatacccacgtgtatatatacccgtctcccgtcgtcagcaggggtggaggattcttgggtttctgctctgttcgtcgatcggcttgagggaaggttcgaaggtgactgaaactcggcgtgttctgtcatggcggctccgaaactgggtcgaatcccgagcatcagggaccgggtcgaggacactctcgccgctcacaggaacgaactcgtctctcttctctccaggtatgtggctcaggggaaggggattctgcagccgcatcatttgctggacgagctcgagaacatcatcagcgaggacgaagggaagagctctctcagcgatggccccttcagtgaggtcttgaaatcagcacaggaagccatagttttgcctcctttcgtggctatagcagttcgtccaaggcctggtgtctgggaatatgtccgtgttaatgtccatgaactgagtgtagagcaactgactgtttcagagtatctgggattcaaggaagaacttgtggatggcaagtctgaagacagttttgttcttgagcttgattttgagccattcaatgcatcttttccccgcccaaatcggtcttcatccattggaaatggtgttcaatttctcaatcgtcatctttcgtccattatgttccgcaacaaagactgtttggagccattacttaattttcttcgagcacacaagtataaaggccatacactgatgctgaatgatagaataccgagcatatcgaggcttcagtctgctttggctaaagcagaagaatatctttcgaagctgccaactgatacaccatactctgaatttgaatatatgttacaaggtttgggatttgagagagggtggggtgatactgcagagagggtactagaaatgattcatctcctattggatatactccaggctcctgatccctctactctagaaacatttcttgggaggatacctatggtgtttaacgttgtcattttgtctccacatggatactttgggcaagcaaatgtgttgggtttacctgacaccggtgggcaggttgtttacatactggatcaagttcgtgccttggagaatgaaatgttactgaggatacagaagcaggggctggatatagctcccaaaatccttattgttactaggctaatacctgattcaaagggaaccacctgtaatcagcggcttgaaagagttagtggaacagaacatagtcatatcttacgagttcctttcagatctgatcaaggaattctgcgtaaatggatctctcggtttgatgtgtggccttatctggagacgtttgccctggatgcagcacatgaaattacagcggagttacaaggctttcctgattttataattgggaactatagtgatggtaatctggttgcttcattattggcttataaaatgggagtcacacagtgcaccatagcacatgctttggagaagacaaaatatccggactctgacatatattggaaaaagtttgatgagaagtaccacttttcatgtcaatttactgctgacttactagccatgaataatgcagactttatcatcaccagcacataccaagagatagcaggaacgaaaaataccgttgggcagtatgagagccacactgccttcactcttccagggctgtacagagttgttcatgggattgatgtttttgatccaaagttcaacattgtctcccctggggcagatatgtgcatctatttcccctactctgaaaagcagaagagactcacagctttgcatggatcaatagaaaagctgctatatgatcctgaacaaaatgatgagcacataggatcattgtctgatcggtccaagcccatgatcttttccatggcaaggctggacaaagtgaagaatatgacagggctggttgaatgctatgctaagaattcaaaattgagggaactagcaaatcttgtagtggtggctggttacattgatgtgaagaagtcaaaggacagagaagagatagcagaaatcgaaaagatgcatgaactgatgaaggaatacaatttggatggtcaatttcgttggatggcagcccaaacaaatcgggcacgtaatggagagctttaccgctatatagcagacacaaaaggtgtttttgttcagccggctttttatgaagcttttggacttacagttgttgaggctatgacgtgcggccttccaacatttgccacttgtcatggtggtccggcagagataattgaacatggtgtatcaggatatcatattgatccatatcatcctgaccaggctgctaccctactggcagatttctttgagcaaagtaaaagggaccccaatcactggactaaaatctctgctgctggacttcagaggatctatgaaaggtacacctggaagatttattcagagaggctgatgacactggcaggggtttatggcttctggaagtatgtttcaaagctcgagaggcgtgagacccggcgatatcttgagatgttttacattcttaaattccgggaattggtgaaaactgttcccgtggcagccgacgagccccattaatctggtggcatcaccgaactcaagagggttgtcgcacgggggcattcaccatgtaaatatttccgtctttcactccaatgcagaagcatgagcatatgccgtattgaataattgagggccagagttcatttgcgctcttgatatgatgatttccattaaataaaaaaaaaaa

SEQ ID NO: 139 - DNA, 2779 bp, Eucalyptus grandis
cgagttttctcctccccattgttacttcgttgcgttcgttttgttgttcgagatccgttctctgtcgggttccgttttgctttctcctcttctgctttgcaagtgttaaggttcttgagaggattcagacatggcggaacgcttgcttacgcgtgttcacagcctccgtgaacgtttggatgagaccctcttggctcatcgtaatgacattttggctttcctcaccaggatcgaagccaaaggcaagggtatcttgcagcatcatcaacttattgccgagttcgaggcgatctctgaggaacataggaaaaagctcagtgaaggagcatttggagaaatcttgagatccagtcaggaagcaataatcttgcctccatggattgcccttgctgtgcgtcccaggcccggtgtgtgggagtacattagggtaaatatccacgcccttgttgttgaggagttgcaagtgaccgagtttcttcatttcaaggaagaacttgtcaatggaaatttgaatggaaactttgtgcttgaattggactttgagccattcactgctcaatttccccgcccaactctttcaaagtccattggaaatggagtggagttccttaaccgccacctttcggcaaagctcttccatgacaaggagagcttgcaccctttgcttgagttccttcaagttcattgctacaaaggaaagaacatgatggtgaacacaagaattcaaaatgtcttctccctccaacatgtcctgaggaaggcagaggagtacctttctgccctcaaacctgagacaccttactctcagttcgagcacaagtttcaggaaattgggctagagagaggctggggcgacaccgccgagcgtgtgcttgaaatgattcggcttctgctggatctacttgaggctcccgatccatgcaccctcgagaatttcttgggaagaatccccatggtctttaacgttgttatcatgtcacctcacggttactttgcccaagacgacgtcctcggatatcccgataccggtggccaggttgtgtacatcttggaccaagttcgtgcattggagagtgagatgcttcaccgtatcaaacaacaaggactggacattactcctcggatcctcatcgtcactcgtcttcttcctgatgcagtaggaaccacgtgcaaccagcgtcttgaaaaggtttttggaacagaatactcccacattcttcgagttccctttagaactgagaaagggatggtccgcaagtggatttcacgatttgaagtgtggccttacttggaaacatacaccgaggatgtcgccaatgaaattgctggagaactacaagggaagcccgatctgatcattggcaattacagtgatggtaacatcgttgcttctttgctggcccataagttgggcgttacgcagtgcacgatagctcatgcccttgagaagaccaaatacccggaatctgacatctactggaaaaagtttgaagaaaaatatcatttctcttgccagtttacagcagatctcatagccatgaaccacaccgactttataatcaccagcaccttccaggagattgccggaagcaaggacacggttgggcaatatgagagtcacaccgcttttacacttcctggactgtaccgagtcgtccatggcattgatgttttcgatcccaaattcaacattgtgtcaccaggagctgatatgagcatttatttctcctacacggaggagaagctgaggttgaaatctttccatgccgagatcgaagaacttctgttcagcgatgtggagaacaaggaacacctatgcgtattgaaggaccggaacaagccaatcttgttcaccatggcaagactggaccgtgtcaagaacttgacggggctggtcgagtggtacggaaagaacacccgcttgagagagctggtcaacttggtagtggtcggtggtgaccggaggaaggaatctaaagacttggaagagcaagccgagatgaagaagatgtacggactgattgagacgtacaatttgaatggccagttcaggtggatctcctcccagatgaaccgggtgaggaacggagagctttaccggtacatctgtgacatgaggggagcatttgtgcagcccgctctctacgaggcttttggattgaccgtggtggaggccatgacatgtggattgccgacctttgcgacttgcaaaggcggtcctgctgagatcattgtgcacggcaagtccggattccacattgatccttatcacggggatcaggcagcggagaccctcgccaacttcttcgagaagtgcaaggtggacccaagccactgggacaagatctcacagggggcgatgcaaagaatcaaggataagtatacatggcaaatttactccgagaggctgctcaacttgacggcggtgtacggcttctggaagcacgtctcgaatctcgaccgtctcgagagccgccgctacctggaaatgttctatgccctcaagtatcggaaattggccgagtcggttccccttgccgttgagtgagttagaggtgaacaaaagggcagatctcaagaggcagacagctttaaaatctctcgagagttaaggaataattgccattgcattggattggaagagagccttttcttttggatttctttttgcaactgctttcgtcaatctttcttttccttctttctgctgtgaatgtatgttgggttaggttcttcaaaaagtcaattaaatgaaatttccttcttcttaaaaaaaaaa

SEQ ID NO: 140 - DNA, 2852 bp, Eucalyptus grandis
atgacataagcttgcgggaattttgagtcttttgaaatctaatggattcaagccccgccttgaagacgacggagccggtccctgacagcatgcccgaggcgcccagccagagccggtaccacatgaagaggtgcttcgccaagtacatggaaaaggggaggaggataatgaaattccaccacttaatggatgaattggaaagcgccatagacgccaagacggagagggagctcgtcctgggcagcgatctcgggtacatcctatgttacactcaggaagcccttgtcgtccctccacacatggctttcgccgtgagacggagtcctggaaactgggaatatgtcaaagtcagttctgactctctgtccgtggaaggcatgagtgccgctgattacttgaagttcaaggcaatgatatacgatgaagaatgggcaaaagatgagaatgccctggaagtggacttcggagctcttgacttttccgttccgcacctgaccttatcttcatctattgggaacggagtcgatttcatctcaaagtacctctcctcaaagctgagcggaacaccggacagcgcacaaccccttgtggatttcctagcatccatcaattatcaaggagaaaatctcatgataaatgaaacacttgacactgcacccaagcttcagatggccctgattgtagctgaagcatcccttgcatcagtcccaaaagacaccccattccaagactttgagatgaggttcaaggagtggggcctcgagaaaggatggggcgatactgcagagaaagtcaaggacacgatcagatggctctcggaagtgctacaagcgccagatccaacgaacatggagaagttctttagtaggcttccaatgatattcaatgttgtgatattttccccccatggttattttggccagtcagatgtgctcggcttgccagataccggtggacaggtggtttatattttagatcaagtgagggccctggaagaggagttgctcctcaggattaaggaacaggggattaatgcaaagccacagatactcgtggtcacacgacttatccccgatgctcgtggaacaaaatgcaaccaggagttggaaccgatcattgggacaaagcattccaacattcttagggttccatttaggaccgagaagggggtgcttcgacagtgggtttctcgttttgacatatatccataccttgagagatttacccaggatgcaaccattaagatactggatcaattggaaggaaaaccggatctcataattggaaactacagtgatgggaatttagtagcgtcacttatggctagtaaactcgggacaactcagggaacaattgcgcatgcactggagaagactaagtacgaacattccgatgtcaagtggaaggagctagacccaaagtatcacttctcgtgccaattcattgctgacacaatagcgatgaacgcaacagatttcatcataacaagtacattccaggagatcgctggaagccacgatagacctgggcaatatgagagtcacgcagcattcacactcccagggctctgcagagttgtttcaggcatcaatgttttcgatcctaaattcaatattgctgcacccggtgctgatcaatctgtttatttcccttactcggagaaacagaaacgactcacacaattaaatcgtgcaatcgaggagctactgtacagccgtgtggacaatgatgagcacattggttatctcgcagacaagaagaaacccatcatcttctctatggcaagacttgacacagtgaaaaacattaccggtttagtagagtggtatgggaagaatgcaaggctcaggagtttggttaacttagtcattgttgggggcttctttgattcttccaagtccaaagatagagaagaaatggctgaaataagaaagatgcatgatttgatagcgaagtacaaactcaaggatcagatccgatggatagctgcgcagactgatcggtaccgaaatggagaactctaccgatggatcgcagatacaaggggagcttttgtgcagcctgctctctatgaagcattcggcctgaccgtaattgaggcaatgaactgtgggttgcccacaattgccactaatcaaggcggcccggctgagatcattgttgatggagtgtctggattccacattgaccccaatcatggggaagagtccagcaacaaaattgctgatttctttgagaagtgtaaggtggacaacgagtattggaacaagatatctgcagggggcttgaaacgcattaatgagtgctacacctggaaaatctatgcaaacaagatgttgaacatgggatgcatctataccttttggaggcaactgaacaaagaacagaagcaagcaaagcagagatatatccagatgttctatagccttcaactcaggaactcgatgaagactgttcccatcaaaactgatgaacctgaacaagcagcaccaaagccgccaccaaaagtacagcccacgatgagcacaaggaggacgcagtcgcggatacataaataaggattcagtggccctacagctaccatttaaaataaaattcagtcagcgatggcgcaagcaacatcactttgaaactgaattgcactttacttttcagaatgctgggaacctagaggaataaaataaatgaggaagccattgattcaaactgcaggcaatcctccgcaatttagagcttgactgtgcattgtctagctgcttaaaatataatccaatatgcgtggagcagcaaaatgtaataatatgaaactaagaatggaataatacaatgggcattcttttctaaaaaaaaaa

SEQ ID NO: 141 - DNA, 2692 bp, Eucalyptus grandis
cacttctaaagcacggcgggtttcactttggtggttcgtgcagttttgttacgagagaaggattaagccatggcggatcgtgtgctgaaccgaagtcacagccctcgcgagcgtttggacgaggccctctttgctgaccgcaacgattgtctggtcttcctgtcaaggcttaaagccaagggcaaaggcatcttgcagcgccaccaaatacttgctgtgtttgaggcgatccccgaggagagcagagcaaggcttcttgatggggcttttggtaaagtcctcaaatccactcaggaagcgattgtctcgtctccatgggttgctcttgctgttcgtgcaaggccaggtgtgtgggaacacatccgtgtgaacgtccatgcgcttcttcttgagcacttccaggttgatgagtatctgcacttcaaagaagcgcttgttgatggaagcttgaatcctgattctgagccacttactgccacttttgggcggccgaccctttccacgtctatcgggaatggcgtcgagtgtatccgtcgcagtctctctgataagctcttccctgacaaggaaagcttgcaccctctgcttgaattcctccaagtccacagctacaaggggaagaacatgatggtgaatgccagagtccagaatgtgtcctccctccaacctgtcctgaggcaggcggaagagtatctgaacacgctcaaacctgagactccgtttcccaagttcgagcacaagttgcaggagatcgggctggagcaggggtggggcgacacggctgagtgggtccttgacatgattcaggacctgttggatctccttatggtccccaacccaggcgctcttgagaagttcttgggaaggattccaatggtcttcgatgttgtcattgtgtctccccatggatactttgctcaggacaatgtcctaggttatccagataccggtggccaggttatttacatcctggatcaagttcgtgccctagagactgaaatgcttcaccgcattaagcagcaaggcctagatattactcctcggatcctcattatcactaggcttctcccagatgcggttggaaccacctgtggccagcgccttgagaaagttttcaggacgaagcactcccgcattcttcgcatccccttcagggacaagaagggaatcgtctctgagtggatttcccggttcaaggtgtggccatatttggaaagattcgctgaggatgtcgcaaaagaactcaggggagagttgcagcgcaatcccgatctgatcattggtaactacagtgatggaaacattgttgcttactcgttagccaaaaaattaggtgttacacagtgcacaatagcacatgcccttgagaagggaaagtacccagggtctgacatatactggaagaaatttgacaacgaataccacttatcttgccagttcaccgcggatctcttgaccatgaattacaccgacttcatcattgccagcacctccgaagaaattgctggaagcaaggataccgtggggcagtatgagagttacacgaactccactcttcctggactctaccgagttgtccacggtatcaacgtctttgacccgaaattcaacattgtttcaccaggagctgacatgagcatctacttcccctacaccgaacagaagcggcggttgaaatctttccaccctgagatcaaagagctcctcttcagcgatgtcgagaacaaggaacacttgtgtgtgttgaaagataagaacaagccgattattttcaccatggcgaggcttgaccgtgtcaagaacttgacagggcttgtcgagtggtatggcaagaaccccaagttgagggaagtggccaacttggtcgtggtcggaggtgacaggaggaaggattcgaaggacttggaagagcagtctgagatgaagacaatgtacgacctcatcgagaagtacaagctgaatggccagttcaggtggatttcctcccagacgaaccaggtgaggaacggagagctctaccgctacatctgtgacacgaagggagtcttcgttcaaccggctatctatgaagctttcgggttgactgtggtcgaggccatgacttgtggattgccaacctttgccacttgcaatggtggaccggctgagatcattgtgcatggtaaatcaggctaccatattgatccttaccatggtgaccaggcggccgagcttcttgtagagttcttcgagaagtgcaaggttgacaagagccactgggacaagatctcaaagggtgccatgcagagaattgaagagaagtatacatggaaaatatactctgagaggctgttgaacctgactgccgtgtatggcttctggaagcatgtgactagccttgatcggcgcgagagccgccgctacctcgaaatgttccatgccctcgtgtatcgcccactggctcagtctgttccccccgctgtcgagtaaagaaagagacagattgttaccagaagatggaagcattggatttttgaagttttcaaggaataaacattggaaattgtttgaatttgggattgccaagagcgatctctttcatttccttttttggtcctttttctcttctttgtttccattccgagaatgtttgcattttgggttttgtacccatcaattcagtaaatggttcattttcttttcaaaaaaaaaa

SEQ ID NO: 142 - DNA, 1755 bp, Eucalyptus grandis
actttttaaaaacacttgagcacgcccgcacactccatatccagctcatcgagcaccatccatggcggcttccttcctctccaatccctcctccctctccttcctcctcctcctcctcctcctccacgcttctcgcctcgccttttcgcagtccttcgtcggagtgaactatgggcaggtggccgacaacctcccgccgccggagtccacggcgaagctcctgcagtcgacgacgatcgggaaggtcaggctgtacggcgcggatccggcgataatcaaggcgctggcgaacacgggcatcgggatcgtgatcggcgcggccaacggcgacatcccctcgctggctgccgatcccaacgcggccggccagtgggtcggcgccaacatcctccccttctatcccgccagcaagatcaccctcgtcacggtgggcaatgaggtgttcatgtccaacgacgagaatttgatgtcgcagctcctgccggcgatgcagaacatgcagagggccatcaccgccgccgggctgggcggcaaggtgaaggtgtcgtcggtgcacgccatgtcgctgctgagccagtccgacccgccgtcgtcgggccggttccacccctcgttcgaggcccggatgagggacgtgctgcagttccagcgggagaacggctcgcccctgcccatcaacccgtacccgttcttcgcgtaccagagcgacccgaggcccgagacgctggcgttctgcctgttccagcccaacgccgggcgggtcgactccgggaccgggatcaagtacatgaacatgttcgacgctcaggttgatgctgtttactctgccctaaaggctttgggttacaaggacattgaaatcatggttgcagagacggggtggccgtacaatggcgacagcaatgaagtcgggactagcgtagagaatgctaaggcttacaatggcaatttgatcgctcaccttagatctttggttggcactccactgatgcctgggaagtccgtggacacatacattttcgcactctatgacgaggatttgaaaccagggcctacttctgaacgatcgtttggaatgtacaagcctgatctgaccatgacttatgacattggtcttgcgaagagtagccagaccccagcttctccaaaagctccagtgactccgaccccagtgactccgaccccaaaaccaacaggaccgggctggtgtgttcccaaatctggcgtttccgatgctcaattgcaagcaagtctcgactatgcttgcagcaataacatcgattgcagtccgatccaacctggcggtgcttgctttgatccgaacaccatagcgtcgcatgcagcttttgccatgaacctctactaccaaacattaggcaggaacccttggaactgcgatttctctcaaacagcaacgctcacgacgaacaatcccagttacaatggctgtgtttaccctggtgggagcacctgaagtgcgatagaactgtatcattagatgatatatataaagcggaataaggaatggcggtgtagttgaagaactttgtccccatatttagttgtaaagcccttccttcttatatttataggtgtaatacaaatacatatatgtagcccttttctccgtcattttattttttttcctcataaagttaatgagtatgggaaaatcgatccctaaggttttaggtttgaataagtctccatatcgtgccgtgtaccttatttcctagatcttcaatgaagctacat

SEQ ID NO: 143 - DNA, 1705 bp, Eucalyptus grandis
ggaggaggttgctggcgagtggttgctgctgacacctttttttcttggtgggcattgaggggcgggaggtcttcgatcctagaacgcatcaatggcttcctcctcctcgctcctcagagccctctttcttctactttctctctcagattctgcgactcaaattctaggcctcgagttcgggattaattatggccaaatagcggacgacctgccctcgccttctcgtgttgccaccctccttggatccctcaacgtcagtagggtaaagttgtatgatgcagatcccaatgtcctccaagcattttccaattccaatgtcgacttcatcattggtataggcaatgacaatctccagaacatgaccattcttgccaacgcccaagattggatccaacagcacgtccaaccttacattggccaaacccagatcagctgcatcgtggttggtaacgaagtgttaaacagcagcaataaccaatggatgccctatctcgtcccggcgatgaaaactgtatattcggccctttccaaccttggactgaataagcaagtcgcggtcacaacagcgcattcgctcaatattttagctacttcatacccgccctctgcaggttctttctggccaaatcttgctcagtacctccaacccctgttgaatttccaggcgcagataaatactccatttctcataaacgcgtatccttactttgcgtataagggtagtccgagcgaggtgtcgctgaattatgtgcttttccagcctaatgaagggctgaccgatcccgtcaccaacttgcactatgataatatgttgtacgctcaaattgatgcggtttattcagctattaaagcgatgggacatactgatatcaccgtcaggatttctgagacaggttggccgtccaagggtgatgacgatgaggcaggggctacactggagaatgcgcatatatacaatgaaaatttgttgcagaggatagagcagaaacaaggtacccctgctaagccatcggtgcctattgacatatacgtgtttgcgctatttaacgaaaacttgaagcctggtccgacatctgagaggaactacggactctactatccagatggtactccagtttatagccttggattgcaaggttatcttccagaactatattcagcgactgggacaagaccaggattatattcagcgactgggacaagagtattgcctttctctgttgttttagtatccatcatgacattcttaatgaatatttgagagcatgctaatctgtttaccgagggaaggcttcaacaaaacaatctcgaagcaactttttagattccagagagcttacataatcacatagcgcgaatggatgagattattcagctacactagatggagttttgacttgaagagtgtactagtatgtctgtctttgtctgtcatagtgaaataacacaaatcgctaagtaaagtttaggatcctaggaaattaacacactgattcatgacatagcttatgtaataaaagcatggggtatagcgggtcgatacaatcttgtacgaacacgttctgggagggactctcctgatgtggaagaagctcgagctctactatggtccttctttatatggtgggtgtatatggactttacattatttgtacttgatttaataagatggaccggatagatcgtggatttctcaaaaaaaaaa

SEQ ID NO: 144 - DNA, 1872 bp, Eucalyptus grandis
gccacagtctcctcctccatcaacacagccactgcaactctctctctctctctctctctctctctctctctctccaccgttcacagtctccatctctccgcctctctccgccatggcttcctccgcattacctccgtccaacctcctcctcctcctcctcctcctcctcatttccggcctcgcgtgcgtggcggccatggcggccccgatcggcgtcaactacggccagatcgccaacaacctgccgtcgccggaccacgcggtgacgctggtgaagtcgatcggcgccacccgggtcaagctctacgacgcggactcccgcgtcctctgcgccttcgcccacaccggcgtcgagttcacggtcggcctgggcaacgagttcttggtccagatgaaggaccccaagaacgccctctcctgggtcaagagcaacgtccagtccttcctccccgacaccaacatcaccaccatcgccgtcggcaacgaggtcttcacctccaacgacacctccctcagggacctcctcatgccggcgatgaagaacgtccacgacgcgctcgccagcctcggcctcgacaagcaggtcaccgtgaccacagcccactcgctggccatcctcgagacctcctacccgccgtcgacgggcagattccggcgggatgtcgcgagccgcgtgagccaggtcctggacttccaatgccagaccgggtcgtcgttcctgatcaatgcctacccctacttcgcgtacaaggccaacccgaagcaggtcccgctcgacttcgtcctcttccaggcgtcgcagggtatcaccgatccctccacggggctcaactacgagaacatgctgttcgcccagatcgacgccgtccactcggcgctcgcggccgtcgggtacgcgaacatgacggtgcacgtgtcggagacggggtggccatcgaggggcgacgacgacgaggtcggggcgacgccggagaacgcgaagaagtacaatgggaatctgataaagatcgtgaagcagaagaaggggacgccgatgaagccgaactccgacctgaacatatacgtattcgcgctgttcaacgagaacatgaagcccgggccgatgtcggagaggaactacgggctgttcaagccggacgggacgccgtcgtacacgctcagcagcggcggcggcggcggcggcggcggcggcgggacgagcaatgggacgagctctggagggttcggcgggggcgggggcgggggcgggagcgcttccgacgggacgccaccggcaccgattggctacctctccgtttcctccggcgcgaacgaacttcgatcattaggcgcggcatgtctcatgttggctctgttcctgatcaagctcgtcttttgaagcatgaatccgtcttatttcgaattgggtgatcatcaacgaagtgggttatctaaaaagaaggtgaaagactttttggattctctttttgcttgtaaatcagctccccaaaattcacgggcatatgagtgtctctcccatccatcatatcttccccgtcgcatcctgctctagcacaagttgcacagagagagagagagtgctttcgagaacatcacttgctattattggtactgcacttgggtccatttcatcagagaaatgcacagagagtagggacatcaagtgggtgggacgtgtaaatgcgaaatgagtggtagcttttttctgtttggttggctatgaactgtaattgttttggcacttcttttttggcgttttgggggaggttggtgggggagagaattgtgcagtgtagtgtcttcaataattcctagatgccaatgtactgtcattttattgctattctattccaaaatgtcctaaaaaaaaaa

SEQ ID NO: 145 - DNA, 1381 bp, Eucalyptus grandis
ctttgcccaatggcaaaatcttctccctttgctgcagactccctctcgattccttcaatgctgctctttgctctcatggtgtttacaatcctgcacaggacagctgcccagacaggcgtttgttacgggatgcttggcaacaatctaccatcggcgcaagaagtcgtggccctttacaagcagaacaacatccccaccatgcgaatctacgacccaaatccgcaggctcttcaagccctcggcgggtctaacatcgagctcgtgctaggcctcgcgaaccccgacctccaaagcatcgcctccagccaggccaacgccagcgcatgggtccagaacaacatcaagaaccacggcaacgtccggttcaagtacgtcgcggtcggcaatgaggtcaagccctccgactcgttcgcccaattcctcgtccccgccatgcgcaacatccggactgcactcgccggcgccggcctcgagcagatcaaggtctccacatcggtcgacacgggcgtgctcagcgagtcctttcctccctccaaaggcgtgtttaggtccgattacatgcctctcctcggccccattattgggctcttggtcgagacccaagcccccttgctagtgaacgtgtacccttacttcagctacatcggcgaccctcaaggcattagattggactacgcgctattcacggcgccctcggtggtggtcacggacggggcattgggttaccagaacctcttcgacgcttcactggatgcggtctactctgcgctcgagaaggccgacggcggctcactgaagatcgtcgtgtcggagaccgggtggccttcggccggaggaggggaggcgacaacgctcgacaacgcgaggacttacaacaccaatctggccaagcatgtcaagggagggacaccgaggaggccccgtggcccgatcgagacgtacgttttcgccatgttcgacgagaaccagaagagccccgagactgagaagtactgggggcttttccttcccaacaagcagcctaagtactcgatcgatctcaattaggagaggatcttgtcaggtcctattatgatgccgtgtgggggggtgcaatgagagcatgttataaccccgaaaaaataaaaggagcatcactagtcgaatcgatttacataaggattaaatttctgtttcgatgatgattactttcctcatttcgatcatttactgttgtcggtagtatctgattcaattttcgtgcatcaaaccaggttcacctttaactttgtatccggtcaattccgatagtttcgtcacgtcatcgatatggatttatgcctatgtggaaatgcggaaggggcagcaataggaatttctagagtttgttctaaaaaaaaaa

SEQ ID NO: 146 - DNA, 1662 bp, Eucalyptus grandis
gcgagactcgctctcatggcgaacccccacctcccaccgctctccctcctcctcctactcctccttctcggctcggcccacggcgtctccgccgtcggcgtcaactacggcaccatcggcaacaaccttctcccgccgaagaaggtggcgcagctcctccagtccaccctcatcgaccgcgtcaagatctacgactccaacccggacatcctcgacgccttctccaacaccggcatcgacctcgtcgtcgccgtcgagaaccccctcgtcgccaacctcagcaaggacccctccgccgcggccgagtggctcgcctcccgcgtcgcccccttcctcccggccacgtccgtcgtctccgtcgccgtcggcaacgagtacctcacctccggcgacgacaagctcgagcccaacgacgtggtccaggcgatgcagaacctgcacgcggcgctggtggcgcgcggcctcgaccgcaagatcaaggtctcgacgccccacagcatggccgtgcttgcggcgtcgttccccccgtcctcgtccaccttcgcgatgactctgctcccgaccatgacctcgatcgtgcagttcctcgccgacaccggcgctccgttcatgatcaacgcgtacccctacttcgcttaccgcgacaaccccagctccgtcgacctggagtacgcattgctcgggaacaagacgaccgtccgcgatccgaaggggtacgtgtacacgaacatgctggacgcgcagatcgacgccgtgaggtcggcgatcggggcgctggggttcgggaaccggtcgatcgagatcacggtgtcggagtcggggtggccatcgaagggagaggacggggacaaggcggcgacgccggagaacgcgaggacgtacaacacgaggctgatagagagggcgcaggcgaacagggggacgccgatgaggaaggaggagagggtggagatcttcgtgttcgcgctgttcaacgagaacaagaaggaaggcggcgtcgccgagaggaacttcgggctgttcgccggcgacgggtcgaaggcgtacgacgtggacctgagttgccagttctgcagcggcggagtgtcggggttcggagagaaagcggctgggagcagtggcgtggccctgagggggccgtcggtgtggtgcgtggcgaagccgcacgcggaggagggggtgctgcaggcggtggtggacttctgctgcggcgccggcggagtggactgcagggaggtgtacgagggaggggactgctacgcgccggagaaggtgcacgcgcacgcgtcctacgccatgaacgcctactaccagatgcacgggaggaactactggaactgcgacttcaagggcaccggcctcgtcacgttcggcgaccccagttacggaagatgccggtactctcagcagtagtagaggaagcaaggaatcaaatcgaatgggcaccctgcgcgcttgaacagtcgagcgcttttctcgatgaaaaagcacccaccatcaagtgtgtactcgattggagattttgaatgtgttgaattatatcgtgtgggttccacttctatccataaatgtcttcgaaagtgatctggccttttcctcgacctaagcaaaaagctcgactttttgtgtcgagagaaatggtccaaatttttaaaaaaaaaa

SEQ ID NO: 147 - DNA, 2247 bp, Eucalyptus grandis
gctctctttctcaccagacgtttcctgcgacagaatataataaggaccttattctgcgaatctctatctctctccctctcccgggtcccaacagacaaatcgttgaagcccggatcttcttatgtccttcaaaaattctagtaaatccgcattaaatctctataaatctccgcgtctttcgacactacatccgagcattaacatctgttacaatctcccttatcgccaatctccacctatctccttaaccccttttctattgtttctcaaatacccccgtctctttcttggcttcttggcttctcagtctcagccatcattgaccacccaaagaaaaagaagaaagttgaaacctttggggtagatagaaaacagggctcctggttagaaagaggcggggtcgttgatttcgatgcaaatgggtcttttgcatctgctcgtcttctcttctctgctccttgcactgtgcagtgcggagattttgagcaaggtcggagtgaactacggccagctaggaaacaacctcccgtcgccgacccggtccgtctggctcatcaagcaccagctcaaggcccagcgcgtcaagatctacgatgccaacccgagcattctccgagcccttaagcacaccggcattcaagtctcggtcatggtcccgaacgagctcatcaacgccatcgccgtcaaccagacgctcgccgactcgtgggtcgggtccaatgtggtgcctttccacccggcgaccaagattcggtacctcctcgtaggcaacgagatcctcagctccgctgacaacacgacttggttcaacctcgtgccggcgatgcgaaaggtcaagaaggccctgaagaggcacaaggtccaccacaaggtcaaggtggggactccgctagcgatggacgttcttgcgacgtcatacccgccctcgagcggctcgttcaggcccgacgtgtcggaccgtgtcatgaagccgatgctccagttcttgaaccggaccaaatccttctttttcatcgacgtgtacccgtattttgcctggtcctccgacccgaagacaatcgacctcaactacgcactgttcgagtccaagaacgtgaccgtcaaggaccccggcaccggcctggtctacacgaaccttttcgaccagatggtggacgcggtaaccttcgcgatgaagaaactcgggtacccgaacatcccgatctggatcgccgagacgggctggcccaacgccggcgactacgaccagatcggcgccaacatctacaacgccgccacgtacaaccgcaacgtcgtcaagaagctctcggcccgaccggccatcgggacaccggctcgacccggttgggtcctgccttccttcatgttcgcgctctacaacgagaaccagaagacgggtccgggcacggagcggcacttcgggctgttgtacccgaacgattcgttcgtgtacgacatcgatctcagcggagagacgccggacactgagtacgggaagttgccggcgccgacgaacaacgagccttacgaggggaagatatggtgcgtggtggcgaagcgagcgaaccggagcgcgttggcgtcggcattgtcgtacgcgtgctcgcaggggaacgcgacctgcgggccgatccaaccgggcaaggcctgccatagaaaaggttcgctggtccggcaagcgagctacgcgttcagctcctactgggcccagttcaggaagacgggcgggtcttgttacttcaatgggctggccactcaaaccatcgaagacccaagttatggatcctgcgagttccctgcagtgactctctgaagaacttggactggctagatgaggtgatgccaccttctccgtttttcctcttcaggactcgggtgcttgtcccctctgacagcatattttcttggaacaacttggatattactgattaagccaaacttttagggcatgtggcaaactcaagtcaatcgttttcatcgtctttggttgtgtcatcacaacgagccttagatgaatgatgggcaggtgaaatcagtagtcagtttcatcaaaagttgcgttggtttccagattgctactagaaggtttcaacgactacatcccaccatttttcgaaccacactcgaccttacctaccttctgattgagacaatttgttgatgatccatggcaagcagctatttctgcatgttcagacagactctttctttaaattcatatgaagcattgctgctgtaaaaaaaaaa

SEQ ID NO: 148 - DNA, 2030 bp, Eucalyptus grandis
ggtttttctcagatgggttttctgtagtgggaatagagtgatgtttcttttccacaggccatttaggtttagacaagcagagtgttgtctggagtcttctggtcttcagcttcggcagtcagtgctgcgttctcaggaaagggtgggaagttgatgaaatctttggtaggttctgctcgagatttaacacgcggggttcggactttttgggagagagatatccatgtgcgattttcttcttttgagctggttttgtgcgcaagagactgatttaagctccatctaaaggcgacgaaagagagtgggaggttttgtactccattttctggagatgatgggtgaaagagggctggggagaattcttctgcttctacttccattcttgcctattgccttgggtgccttcgtgggaataaacattggtactgatgttactaacctgccagaagcttcagatatagtagcagtcttaaaatccaatgagataactcatgtgcgactttacaatgccgatgctcacatgttaaaagcccttgctaacagcgggatcaacgtcatggttggtgtcacgaatgaggaagttttagggattggggaatatccagcaacagcggctgcttggattaacaaaaatgttgccgcttacctgcctgcaaccaatataactgcaattgcagttggcagtgaagttcttactgcaatacctcatgcagctccggttttagttccagcaatgaataaccttcataaagctttggttgcctctaatctcaattttgttgttaaggtctcgaccccacaatcaacggatgtaataccgaagcccttccctccctccgccgcagccttcaactcttcatggaactctacactttaccagctgcttcaattcctgaagaacacaaattcctcatacatgttaaatgcttatccatattatggatatactcaagggaatgggattttcccactcgattatgctctttttcggtcacttccttcggtgaagcagatcgttgacccgaataccctttttcactacagcagcatgtttgatgccatggttgatgctacttattattctatcgaggctatgaatttttcagggatccctgttatggtgacagaaaccggctggccttggtttggtggatcaaatgaacctgatgcgacggcagaaaatgcccaaaccttcaataacaacttgatcaagcgggtgcttaatggctcaggtccacctagccagtcagatgtgccaatcaacacatacatctatgagttatttaacgaggacaagagaccaggacctgtgtcggagaaaaattggggcgtgtttttcaccaatgggacttctgtgtatcctctcagcttgggcacatccggccgaatcacggggaactcttccgggatcttctgtgtagcaaagcaggatgcagattccgacaagttgcaagatgggctaaactgggcttgtggtcaaggtcatgctaattgcgcggctattcaggaaggacagccgtgttactcacccaatactgtggcaaaccatgcttcatatgcctacaatgactattatcagaagatgcagggtgttggcgggacgtgcgattttcagggcacggctatgacaactacggttgatcccagttacgggtcatgtaaattcactggcagttcaaactcgagctccactgtgactactccggtcgcatctgcacctttcagtcctataggcggaggttcgccaacttcagctgtgctagcctccaaactaaaatacgtgatttgcacaatctccgttgttcttacgttgctttgatgaaggggtgggcgcatattcagctagagcagtcgatggcgggttactggtagatcttggctgtgatgaaattggtgggagattcttgagcttagtgaggattcttgttcatccatcccttctcattttttttgaatgtgctttagagatccttgcgtttagttcctcgtggtctgttttatgtcattgtaacatttgattaaaaaaaaaa

SEQ ID NO: 149 - DNA, 1403 bp, Eucalyptus grandis
ccacctctttctctctctctctctctctcctaatgtctctcttctccttccttctctctccctccctctgttcaagttatcatctttgcgccaaagggtataaaacccaccatcccctttcgaccagaccccccgctatctcccccgtctgaggtgctgtgaaagcttttcgtctcctttcgtcgcaagaagaggaagaagaagaagaagaagggaggctggcgagattggaagaatatatatgggtggaaagcgtgtgcgctacgcaataatcctgctatgccatctcctcctatgctcaggttcagggtcgcttgcgacaaggaaggaagcagttggatacgccaatgaaatagcccagggaaaaaagtaccccacctcctcaccttccggccaaaaggacatcaccgatccagtcacaactgtccccaccatgaatccggcacctttcgcttccgccgatccggtggttaacccgacgtcgaaccctgaattggccccaccggccgtgatcagccccatcacgtacccggccatggcgactccgcccccatctttgagttccagctggtgcattgcgagccagagcgtgtctcagactgctctgcaagtcgccctggactatgcctgtgggtacggcggggccgattgctcgggaattcagcccggtgggagctgttattacccaaacacggtgcacgatcacgcgtcttatgcattcaacaagtattatcagaagaatcctgttcccacaagctgtagctttggaggaacagccgtcgttaccagcactgatccaagtacttctacgtgtcaatttcaatccacaagcacagcttcatcaatcttgaacaccacgaactctagtggggccacggtgttcggtgccgtgccttcaggccctcctgcttcgtcagcttcccaattgagttgcattgtgtctcttgtcatgacactgagttggctgagttttgcttctggaatttattaaccaagccacacatgtacagcaatgagctttagttgcagagactctggaggtgccacaatggaatatagagctaatttctacaagatacttgtggcgatctggcggtgtgcctgacattatacttcttgcgacttgaactgtctcgcgactgctaaatccttgatcagaacgggggattaagtagggtgagatgagatgatgatccgatctgtttgtcagctgtagaagaagcctcagattgttcatggtgtggggaaagaacaataagcttgtcgatattggaaatggctgtaagacgggagttttggtaagcccgagttaatactggggagtggaattaccattcatgtaattcgcctagatatttcatctggatcacatgattatgtattgatttttgtcaaaaaaaaaa

SEQ ID NO: 150 - DNA, 1914 bp, Eucalyptus grandis
gttacaatttttggaggaggattcgccgatggcttcacctttcgtctccaccgtaagaaaaaatggcatttttccagtcttaaaaagttctttctccctctaaaggccagaattttccatctctctctctctctctctctgtatctgtctctgctttactgtcgtctttccctctgaacactcaaaagagccgagaagactccttgctgaacctctgaactttacccttctgaggataatgctaggatctgcagctgattctgagcttgaagatggaacagtgaagctggactctctcctcaatggcaatctctaagctcgctcccctcctcttcctcgctctcgtcttcctctccattgccgaaccaggggagccatcgctattcgcagacatcaagcaaggccaggacccagataaggaaccgtacgtgggggtgaacgtgggcacggacgtctcgcatctcctctctccgccgaacctggtctccttcctccaggtccagaagatcacccacgtccgtgtctacgatgcagaccctgacctcctcaaggcgctggccaagaccaagattcgggtcatcatcggcgtgcccaacaaccagctgctcgcgattgggtcgtcaaatgccactgccgcttcgtgggtcggccggaacgtcgttgcttactacccggaaacgtcgatcattggcattgcggtcggcgatgaggtcttgaccacggtgccctcttcagctcctctgcttgtgcccgcaattgaatcactctacagtgctttggtagctgcgaatctccatacccagatcaaggtttcaacgccgcacgctgcgtcgatcattctcgattcattcccgccgagccaggcctattttaaccagagcttggtctctgtgatgctccccttgttgcagttcttgtcaagaaccgggtcacctctgatgatgaatttgtacccttactatgtgtttatgcagaacaagggtgtggttcctcttgataatgcgctcttcaagcccttgacaccagccaaagagatggttgatccgaacactctgcttcactacactaatgtgctcgatgccatgatcgatgccacatatgtttcgatgaagaacttgaatgtcactgatgttgtggtgctcgtgtccgaaagcgggtggccttcgaagggggactcgaaggagccttatgccacagtcgataatgcggatacatataattccaatctgattaagcatgttctcgataggaccggaactcctttgcacccagaacttacttctagtgtgtatatatacgaattgttcaatgaggacttgaggtctccaccgatgtcggaggcaaactggggtctgttctatggaaattccacggcagtgtacttgcttcacgtgtctggaagtggtggatttttggcaaatgatactactaatcagacatactgcattgccatggacaacgtcgattcaagaactctacaaactgcgttagattgggcatgcggtcaggggcaggcaaattgctcggaaatacagcccggggaggattgttatcagcccagcaatgtgaagaatcacgcctcttatgcatttgatagttactatcagaaggaagggaaggctgctgggtcttgtgacttcaaaggcgtggccatgatcaccaccacagacccaagtcacgggagttgtatttttccaggaagcaagaaggtgagcaacgcgaccaagcaggttgtgaactccacagtctcaagcggtgcaactgagagctcaagatttttcatcttcagcagcaacagaagaacagcaattgacaaggctttaggatctgtcttctctgtacttttctcattcttcttagcagttgctctgtggacaccaatctgaaatacataaacataataacagctcctcc

SEQ ID NO: 151 - DNA, 1805 bp, Eucalyptus grandis
gctcgcccgcagctgcagacgagaagaagagaacagaggagaggagaggcgtttcgctcctccactctaagcttctcttcctctgtttctccggaggagaaccaccacaggcattattatggagcatcttcctcttgccttcttcttcttacttctctctgttctctctcttgctgacggcggttccatcggagtgaactacgggcgggtggccgacaacctgccgccggccaccaaggtggtgcagctcctcaagtcgcagggcgtccagaaggtgaagatctacgacgccgaccccgccgtcctccacgccttcgccggcacggggatccggctcaccgtcgacctccccaacgagaaactcttcgccgcggcccgcagcctgtccttctccctcgactgggtccagcaaaacgtcgccgactacccgaccacccagatcgaggccatcgccgtcggcaacgaggtcttcgtcgacacccacaacaccaccaggttcctcgtccccgccatgaagaacatccacaccgccctcgtcaagcacaacctccacaacgccatcaagatctcctcgcccatcgccctcagcgccttgcaggcctcgtacccttcgtcggctggttcgttccggcccgagctcatcgaaccggtgttcaagcccatgctcgagttcctccgccagaccggttcctacctcatggttaacgcctaccccttcttcgcctacgagtccaactccgacgtcatctccctggactacgccctcttccgggagaacccgggcgtcgtcgacgccggcaacgggctccgctacttcaacctcttcgacgcccagatcgacgccgtcttcgccgccatgtcggccctcaagtacgacgacatcaagatggtcgtcaccgagacgggctggccctccaagggcgacgagaacgaggtcggcgccagcaaggacaatgccgccgcctacaacggcaacctcgtccgccggatcctcaccggcggcggcacccctctgaggcggcaggccgacctcaccgtctacctcttcgcgctcttcaacgagaacaagaagcccggcccctcgtcggagcagaactacggcctcttctacccgaaccaggacaaggtctacgacgtacccttgacggtggagggtctcaagaactaccacgacaccgggaagtcggcgccggccggcggcgggcagaggggagtcgcggcgccggtgaagggcgggcgcggcggagtgtcgaagagctcgtcggcgaacacctggtgcgtggccaaaggcgaggccgggaaggagaagctgcaggcggcgctggacttcgcgtgcggggagggcggggcggactgccgcccgatccagcggggatccacgtgctacgacccgaacaccctggaggcgcacgcgtcgtacgccttcaacagctactaccagatgaaggggcgggccttctggacctgcgacttcggcggggccgcctccatcgtatcccagcctcccaagtatggaaaatgcgacttcccaacgggatactgaaaggtgatatgatggacgatgatgacgagactgggggaaattagggattaaaattattatttttagcatttgggcgggtgggttttaaatgtagaattctacatttttttggggggttggggggtccctgttgctgattgtatctaattccagagttgtcgtaggggggtcatgagaaaagctaatcttcttccactacttgtagcaagcgttgtccatatttgagagatatgacacttatgtttttcccccaaaaaaaaaa

SEQ ID NO: 152 - DNA, 1887 bp, Eucalyptus grandis
aaattgacatgctgcgccttcattgatcttctgcacctccgcatttgcaagttttatgatcacggagatgtcaaagatcatccccagaatgttgtcagattcagtattcgacattgtcttcttgcttctttcttcatccttcttcatgcaaggagctcgtgctggcattggggtcaactatggcacagtcgcagacaacttacctccgcccgcccaagtggcccatttcctcctcgagtccaccacgatcgatcgcatcaggctcttcgatgcggacccagacatactgaaagccttcgctaacaccggcatcgccgtcaccgtcaccgtccctaatgatctcatccctcagctcgccaagctgagcaatgcccaagattgggtgagaactaatgtcgagccttatgttcccgccaccgatattgtccgaattttggtgggaaacgaagtgctggcgaccgcaaacaggttgctattaggcaacctggtgatgtcgatgcggatgctgcacgctgcccttgccaatgcgtcactggacggtaggatcaaggtttccacgcctcactccttagggattttgtccagttcgagccccccgtcgagcgggaagttccggctgggctacgacgtgcacattctaaggccgctgctcaacttcctcagggagaccggctcgcctttcttggtgaacccgtacccatttttcggcttctccaaggacactctcgattacgcgctgttcaggccgaatgcaggggtgatggatgagaattccaaacttgtttacactaacatgttggacgggcaattggacgctgtctactcggcgatgaaggtgctgggcttcaccgatatcgaggtcgtgatagccgaaacaggatggccctcattgtgtgactcgacccaagtcggcgtggatgcaaagacggcggcagaatacaacagtaatctcatccgccatgtatcgtcgggcgccggcacgcccctcatgccaaaacggacatttgagacctacatttttgctctcttcaacgagaatttgaagccgggaccgacgtgcgagaggaacttcggactcttcaggccggacatgaccccggtgtatgatgccgggatcttgaggcccacggctagatcatcggtgccgatcgatcccattccagccccgagctccatgacaccgccgacaagtccggcgtccatgtcaccacccaagggaacacaatggtgcctgcccaaaacaggagcagacccggatgctctgcagagaaatatcgattatgtatgcgggctcgggttggaatgcagaccgatagaagaaggtggcgcgtgctttttgcctaacacggtccgtgctcacgcggcatatgccatgaatgcgtattaccaagccatgggaggaaacaactacgattgcgatttcaaagggaccggagctgttaccgccatcgatccaagctatggaaaatgcacatatcacggatgatggagtttctcttgctcatcagattaggaagaagaagaagacagatcgtccatcttctttccttctccaattttgggacaactgcatctctcttctagttctgcactgtagttctaaactctacatttcacatttcatttttcacggtagatcgaagacagttagaaaggcaaatgctaagagtctgctagccaaatggaattgtaattcgtagtcataaatttacacttctcgtttcttttggcaacatggtctcgagccgttcaactcgagtagtcatgatgactttttttcgtgatgtacctcgtcatgacaacagccatcttggaccggcctcaatacaatgagtaatggaacttttcgtcaattcaatctcttcttattgtttttcaaaaaaaaaa

SEQ ID NO: 153 - DNA, 1787 bp, Eucalyptus grandis
cacgggctgatccatggccaatctcttccccctcgccacagccgtcttcttcctctcggtcgcctgtccccatctctcgcgcgccgcgtacaccatcggcgtcaactacggcaccgttgccgacaacctccccccgccgtcccaagtcgccaccttcctcaagaccaagaccgccatcgaccgggtcaagctcttcgacgccaaccccgacatcctccgcgccttcgctggcaccggtattgccgtcaccgtcaccgtcggcaacggcgacatcatctccctctccaagctccccgcggcccaggcctgggtctccgccaacatcctgccgttccaccccaagaccctcatcaaccgcatcgccgtcggcaatgagatcctcgccacctccgacaagaacctcatcgcgcgcctcttgcccgccatgaaagccctccactcggccctccagctcgtgaacgtcaccaacgtccaggtcacgacgccgcattcgctcgggatactctcgtcgtcggagcccccgagcaccggccggttccgccgcggctacgaccgggccatattcgctccgatcctggacttccaccgccagacgaagtccgccttcatggtgaacccgtaccccttcttcgggttcaccgccaagaccctgaactacgcgctgttcaagccgaacgccggcattttcgacgcggcgacggggaagaactacacgaacatgttcgacgcccagatggacgcggtctactcggcgatgaagaaggtgggctacgaggacgtggagatcgtggtgggagagactggttggccctcggtgggcgacgccaaccaaccggacgtcaacatggcgaacgcggtgtcgtacaacgggaacctcgtgaggcacgtgaacgccgggaagggaacgccgctgatgccgaaccggaagttcgagacctacgtcttcgcgctgttcaacgaggacctgaaaccgtcgacctcggagcgaaattacgggctgttcaagccggatctgaccccggtttacgacgtcggcatcctgagaaacgaaccggctggtgggcccgctccggcgtcgcccagcccgacggcgcagcccagcccgacggcgccgccgacgagctcgggcaagaagtggtgcgtgccgaggtcggacgcgagcgaccaggcgctgcaggcgaacatagactacgtgtgcagcgcccaggtggactgcaagccgatacagacgggcggggcctgcttcgacccgaacacggtgcggtcccacgcggcgtacgccatgaacgcgtactaccagtccatggggcagcacgactacgactgcgacttcgacaagaccggggtggtcacggccgtcgatcccagtacgtcctcctcgatcccctgcttttaaagagatgataaaccacggcgtttgggctaacgacggagaaaatacccgctacccccacccaataataatgattatataaaaaaaaacgtggggacgtggcaggttacgagacgtgcacgtatccggagggcgcttcgagcgtgaggttagaagagaagaagacgtcgtcggtgacgggagatgcgaggaggaaatcgaaggagttgttcatgggaggttcttgctttttgttggcctactttatgttaatttgaagggaaaagaagagtaaagggaattcgaacgttagccctctctctttttgtgattggagcaaatcgcggctttaaattacgtattattggctttttaggtaacgtagattggggggttgcaattgccaaaaaaaaaa

SEQ ID NO: 154 - DNA, 1790 bp, Eucalyptus grandis
cagcttcaatctgaaccatccccccgccgccttgcccccgcagagcactaaaaatcactcctgtatatcttctagccaatcaagaatcccgtctctcacctggatgaccaatcttgaaacccggaaatgctgcaacccaggacgaaagtcgcaacattttcgctcctcctggtgctctcgtcctcgttcccggccgcagaacccgccattggagtgaactggggcaccatctccttccacaggctgaggccgtccacggtggtggatctcttgcagcagaacaagatacagaaggtgaagctgttcgatgcggacccgggtgcgctcaaggctcttgaagggagtgggattgaggtgatggtggggatacccaatgagatgctgaccgtgttgggctcttccagcgttgcctctgatctctgggttcgccagaatgtgtctagttttgttggtaaaggaggtgttgccatcaggtatgtcgcggtaggcaatgagcccttcctctcaagctacgcgggtcagtttcagaattatgttatgccagccctccttaatctacaacagtcattggccaaagcgaatcttgctggttacgtgaagctagtggtcccttgcaatgccgatgcatatgaagcggaccttccttctcaaggggcatttcgtcctgaactcacccaaatcgtgacgcaactcgtctctttcctgaattcgaatggttcccctttcgtagtgaacatttatccgttcctaagcctgtacgggagcacggattttcctcaagactatgcattttttgggggaactactcatgctgtgacagatggggccaatgtgtacactaatgcatttgatgggaatttcgacactctagttgcagcacttactaaattaggttatggtcagatgcccatagttattggggaggtgggttggccaacggatggagctctgaatgcgaatcttacggctgctcgggcatttaatcaaggccttattaatcatgtacttagcaaccgaggaactccattgagacctggagtccctccgatggacgtgtatcttttcagtctacttgacgaaggcgccaagagtgtactccctgggaactttgagaggcactggggaattttctcttttgatggccaggctaaatatgccttgaacctcggtttgggcaacaggctgctaaaggatgcgaggaacgtgcagtatctcccatctaggtggtgcgtggcggacccatcaaaggatctctctgctgtcatgaatcacatgaagcttgcttgtagtgttgcggattgcactacgctcaactatggtggatcgtgcaacggtatcggagcaaagggaaatatctcgtatgcattcaacagttactatcaattgcagatgcagaattcacagagctgtgatttcgatgggcttgggatggtcactttccttgatccgtcggtcggcgaatgtaggtttctggtcggtgtaactgaaagtacgtctgctgccgttgagacatattggagaggggtcattgtttgggttttggttatgtggagtgtctgggtatttgaagtgtgaagtttctcacttggggttgttggtgcttccctcttccgaaagtgaaaccggtagtcatagaagtcaggtcactataatacttagacaatacgcaggattaccctagtatatggaggctctctgtgtttgtcacagggagtgcagttatgtagtaagatgagaacaattgactattaattgacattggcatggtatatcttaaaaaaaaaaaaaaa

SEQ ID NO: 155 - DNA, 1841 bp, Eucalyptus grandis
gtcgtgttgtgttgtgttgtgttgtgttgtgtgttctcggcattggcgaaggactcggagaaaggagctctttttccgaacatggcgatcccgcccctcgccacccttgtactcctcgtcgtactctcgcaggcatcttgcttcgcgaattcgcagtcattcatcggagtcaactatggccaggtcgcagataacctgccgcagccgtcggcgaccgcaaagctactacaatcgacttcgattgagaaggtccggttatatggaacggaccccgccataattggcgttctagcaaacacgggtatcggaattgtcattggtgcagcgaacggcgacattcctgccctggcaaatgatcctaactttgcaaagaactgggtcaacgcgaatgtggttcccttctatccctcgagtaaaatcatcctcatcaccgtgggcaacgaggtaatgacctccggagaccataatttgatgactcagttgttgccggcgatgcagaacatgcagaatgcgcttaatgccgtgtccctgggagggaaaatcaaggtgtcctcggtgcattccatggccgtgctcaagtcctccgagccaccatcttctggttcttttgaccccagtgacgagatgaagggaatcttggggtttaacaatgcgactggttcgccatttgctatcaatccatatccctatttcgcatacaggagcgatcctaggccagagacattggctttctgcttgttccaaccaaacgccgggaggctcgataccaaaacccagattaagtacaccaatatgtttgatgctcaggtggatgctgttcgctctgcattgaactcattcgggtataagaatgtggagattgtagtggccgagaccggttggccatacaagggagacagcaatgaagtcggccctagcatcgagaatgcgaaggcctataatggtaacttgatagctcacctccgctcattggtcggaactcccttgatgcctgggatatcagtagacacgtatctgtttgccctgtacgatgaggatttaaaacctggacccacttcggagcgtgcattcggtcttttcaagtcggatctttcgatgaactatgacattggcctttccaagagtagccagactcccgcagcaccaaagatgcctgctgcaccatcgccaaacgcaactgtcactccatcaccgaacgcaactgtcactccatcgccaaagcctgacaaagcaaattggtgcatacccaagagtggggtgtcggatgcccagttgcaggcaaacttggattacgcttgtgggcaaggaatcgattgccggccaatccaacctggtggggcttgcttcgagcctaacaccttggcagcacatgctgcatatgccatgaatctttactaccagaactctaaccgcagtcctacgaactgcgacttctcgcagtctgcaacattctcgtcgaataacccaagttacaacggctgtgtctacccaagtggaaagagctgaaggcggcggatcatcgtcctttcaaggaaaccaagaagttgtgaattcgtggcgtgtgcattagggtacttatcataatttgtgttgtgctttactgcggtggcaaaaccgacagaaagtcctacatggtgtaggaatgtagcaatgtactcaaacttgatggctcacatgtataggaactctgttgcgccgatcaagtgatttgtcaaagtgatccttttatgtttagctgcggatgttcgtttcttagtccctgattggcttgtgagcttacggccgaaacactcactgatctccaaatacagcagtctgaaatatttatctgaaaaaaaaaa

SEQ ID NO: 156 - DNA, 1852 bp, Eucalyptus grandis
cctcgtgccgctccttccacattccaccccttatagttttttgggctgtgctgttttctgattctttcaagatttttcccccttttttccctcaggaaaattcagagagacccatctgaagaatctccaaagaaaatggcagaatcaatatctcattatccctttccgacccttggactaatagttctctgcttcatgaccatgttctcaattgggtcaagcgttggagtgaactgggggacgcagtcaaaccaccagctcccgcctgagaaagttgtgaaaatgctgaaagaaaatggcatcaagaagctgaaactgttcgaatatgatgagaagattctgggggctctcgctgggagcaaaatcgaagtgatgcttgccgttcctaattacatgctggagattatgagcgtggatccaagttttgctgcctcttgggtggacacgaatgtcaccagttaccgatacaccggtggagttaatatcaagtacattgctgtaggaaatgagcccttcttgcaaagctacaatcacaagtatgtccgacaagtattgccagccctccggaacattcacgaggccctccaccgtgcccggctaagctccaaggtcaaagttacggtcccgttcaacgccgatgtctactattcgccgcccccaaacgagtacccttcttccggtgacttcaggcctgaagttcgtgatgcagcgatagaaattattcacttcctatacataaatgattcgcctttcaccgtcaacatctaccccttcctcagcctctaccaaaaccaaaatttccctgttgactttgccttcttcgacggaacgactgagcccgtcaaagatggggatcgggtgtatacaaatgtgtttgacgcgaacttcgacatactcgtctcggccttgactaaagcagggtactctgacatggagatcatagttggagaaattgggtggccgactgatggcgacaagtttgcaaacataaaaaatgcccagaggttcaatcagggcctgctgaagcatgccttgagtggagacggcacaccggcaaggaaaggagtgatcaacgtgtacctcttcagcctaatcgacgaggacacaaagaacatagatccggggaacttcgagcggcactggggattgttcgagtatgatgggaagccaaagtatgaactggacttgtcaggatcggagaaggacacccgccttgtcccagtcatgggcgtgtcctacatgccgcggaggtggtgcattttgaaccccgaattgaatgatctaacagacctaggagagaacatagactacgcttgcaaatcttccgactgcactgctctgggttatgggtcgtcctgtaacaacctgagctcgcagggcaatgcttcctatgcattcaacaggtactatcagatgaatgaccaacgtatcatggcctgcgatttccagggtcttgccgtggtcactgagaatgacccgtccacggaaggatgccaattcccgttgatgatagcgtccggagactcgatgtcctggaaccagggattgctacatacttcgttcagattctatttgtggtttctggttttctgggtaattttatagtccttctgctaggaggttgtcaggttttgctactacagatgctagggggaataacatcagctatttgtattggcatagtcagaaatctaagtatttttgccaaggaatgataatatccttcaagtccatcattttctgttttcaactctcgcttgggagcaatacttttcatttttcttttttgctaggtaaatataagattgcgtaacttctaaagaaagttacatgggaacatacaaaaaaaaaa

SEQ ID NO: 157 - DNA, 1690 bp, Eucalyptus grandis
aaagtgaacctctcaataaggaggagcttctttttcgccttttccgttctgtcctccctctcttttcagtaaaatccctgcatttcccgggaaaaattaaggggggcggagatggaaaaattcgatcttttcaagtgggtcttgtgcggtagcattgttctcttcggggtcggttgtggtcgtgtcgatgggctcggtgtgaattggggaacattggcgacccgcaagttgcctcccaagacggtggtgcagatgttgaaggacaatgggattcaaaaggtgaagcttttcgacgcggatcgtaaaacgatgagcgccctcgcggggagcgggatcgaggtcatggtcgcgatcccgaacgatcagctcgccgtcatgggcagctacgatcgagcccaagagtgggtgaagaaaaatgtcaccgcctataacttcaccggaggagttaatgtcaaatatgttgctgttggaaatgagcctttcctcaaatcctacaatggctcatttgtgaataccaccttgccggcccttcagaacattcaaaaagccctcaatgaagctgggctgggagacactgtgaaggcgacagttcctctaaatgccgatgtatacgaatcgccagaagacaacccacttccatccgccggaacgttccgaagcgacataagtgatgtcatgacccaaatcgtcaagttcatggctgagaacaacgcacccttcaccgtgaacatttacccgtttctgagtctttacggcaataatgacttccctttcaattatgctttcttcgacggtgcaactccaattgttgacaaggggattgagtacaccaatgtctttgatgccaactttgacactttggtgtcggctcttaaagcagttggacatgggaacatgaccatcatcataggcgaggtgggttggcccacagaaggtgacataaatgcaaacaacggtaacgcgtacaggttttataatgggctctttacaaaacttggagcgaatagagggactccacttcggccaggttatatagaagtgtatttgtttggtcttattgacgaggatgccaagagcgttgcaccaggcaattttgagcggcactgggggcttttcagatacgatggacagcctaaatttctaatcgatctcactggtcggggtcaaaataagttgctaattcctgcacagaacgtggaatatcagcctcagaagtggtgcacgtttaatgcaggcgccaaggacgtgagcaagctagtagataatataaacttcgcttgcacttatgcagactgcacaactctcggatacgggtcctcctgtaacagtttggatgccaatgggaatgcttcatatgcgttcaatgcatatttccagactcagaatcaggatcctgatagctgtaatttccaaggtttggccacagttaccactaaaaatatttcgcaagggagctgcaatttcacaattcagctagttgcatcctccacttctatattgcgcccactgattgtgttgacggtgatctcgatggcttatacctttttgttacagtagttttgattgtagatatcagtatgatgatttattatttgaattttgctaagccgtctcttgtatctcccatttgattgatttgcagtgtgacattacaatttaacagagttcataaaaaaaaaaaaaaaaaaaa

SEQ ID NO: 158 - DNA, 2961 bp, Eucalyptus grandis
aaacgcgctacggactgatcatggccagcctcttccccctcaccgcagccgtcgtcttcctctcggtcgcttgtccccatctctcgcgcgccgcgtacaccatcggcatcaactacggcactatcgccgacaacctccccccgccgtccaaagtcgccacattcctcaagaccaagaccaccatcgaccgggtcaagatcttccacgccagccccgacatcctccgggccttcgccggcaccggaatcgccgtcaccgtctccgtcggtaacgaagacatcgtctccctctccaagctccccgcagccaagtcctgggtctccgccaacatcttgccgttctaccccaagaccctcatcaaccgcatcgccatgggcaatgagatccttgccacctccgacaagaccctcatcgcgaacctcttgcccgccatgaaagccctccactcagccctccagctcgcgaacgtcaccaacgtccaggtcacgacacctaactcgctcgggatactggcgtcgtcgtatcccccgagcaacggctcgttccgcagcggcttcgaccggaccatattcgctccgatcctgaaattccaccgccagacgaactcctccttcatggtgaacccgtacccgttcttcgcgatcacccccgagaacgtgaactcccttctgaactactcgttgttcaagccgatccccagcagcactttcgacgcggcgacggggaaaaactacacgaacatgttcgacgcccagatggatgcggtgtactcggcgatgaagaaggtgggttacgaggacgtggagatcgtggtgggcgagaccgggtggccttcggtgggcgaccccaaccagccgggcgtgagcatggcaaacgcggagtcgtacaacagtaacctcgtgaggcacgtgaactccggcaagggaacgccgctgatgccaaaccggaagttcgagacctacatctttgcgctgttcaacgagaacaagaaaccgtcgacctcagagcggaattacgggctgttcaagccggatctgaccccagtttacgacgttggcatcctgagaaattcggtaaatgccgttcctttacatcttttaggctagtactagcgtaacagtcttttgttatcctaaaaacaataatttattatgaatcacaaatttttaaaaaagtagaccccgtaataatttatgaattttctagtataatagaataataacttgttgtgaataacaaattattaaaaaagtatatctcacaataatttataattatttcttattttattttttataattcttagattaaagactatcattcaattatttcacaaaccaggctttgctaggctactgagagaataataacttgtcgtgagccacaaattattaaatgaatccaatttataattatttgttatttgattatgtgctttattctcacaatagattaaagactgttacccaattattttttaaatcggacttttctagcataacagtctttaggcgactataagaataatggtttgttgtgagccacaagttcttgataaagtaatccccacaataatttataattatttgttaattgattttttttttataatctagaacatactattattgtcacgataaattaaagattgtcgtccaatcatttctcaaatcgggctttactagtataatagtttttagattattgtgagaataacagagctttatagactttacagtaatttataattacttgttatttgctttttgtgatatagaataaattgttattctcacaataaattaaagacaattatccaatcatttcttaaagcgggttttgttagtataacaatatttgggctactatgatgtgagccacaaattcttgaaagagtggactttacaataatttataattatttattatttgattttttgtcatcaagaatagacctttattcttacggtaaattaaagacaatagattaataactaggacttatgtacacgagtatagaaagaaaatgagagttaagtatgccaaaaccgataatattgaggctgattttgattatggcattaattgacttcaacaattgatgggacattttttcgctcaagttttaggagggaacgaggaagtgcttttttgattgattgagcttgtaaatgatatgttttttgaccttggaaaatttggccatcgtcgtcttcggtggttttcaaaccttcgacgagtttagagaatatgttgcacgtccaaaatttgttctctttttatctgtatgaagggataatttttttttttttggggctatgagtgagctttggcatttaagggaatgtttggtcacgtaccaaataatacttgattctattcttttattctttgtaaccaacaaaaaaagaaaagaaagaatattatgctttttttttcctctcttttattttattcttttccttttcttttctcttcttcttcctctagctggtcagaaaaatataataaaattgtataataaaattaaaatatataatgaaataatttaaaataaaataaattttattaaaatatttattaaaatagaaaaatagaaaaaatataataaaagtattaaaaaaattaatgatcgtaccaaatgtatttttatttcggaaatagaaatttttggtaattatcaaatgtttacaaatgctaagaaatttgtctaagaaataaaataaaaaaaattactttttcgcataagttatttttaagaacaaaatgattactaaaagcaccctcctcggatagctcttgcttctaagcacgcgtctgccatggaaagagacattggctcctttgcttcagctccactttgcccagactgtcctcgctgcgtggcaaaatttatgcccctggatccaccctagtggagggcaatatcagtccatgaaaacttttaatcgaaaaaaaaaa

SEQ ID NO: 159 - DNA, 3320 bp, Eucalyptus grandis
tgcatcccgaaaggaatgatgaaccttcatttccaatacaagcatccaaagcgcacttaggctacaaaccaaatctgcaagacaaagcaaaacgaggccgagaatttatggagcgtcagccttacctcaaaagcgattctgggttgttcttgatagtgctctgctagccccaccgcgaaggaatgctagcctttcgacattatctccaacaagatctaaaggaagggtttttcgaggatctcgtctctggtcttttcttggggctttcaaataaatggttctggatagggtggtcccactcttttcttatgcttcacttgatcatcctgttgcagagcctataaaatgaggagggtttgtgcctgtttcctcacaagtcctgccaaaacccctcccaagcacgggacccagcgggtatccaaacagactgctggtaaccaaaagagtgaaagcgctagcaacaactcagaggtcatggccaactccagcggtagtcaggggacaaatatcatacagaatcataatttctctggaggattgcattcttggcatcccaattgctgtgaaagctgggtggtctctgcagaatcgggtgattgctatgctatggttacgaatagaaaagaatgctggcaaggattggaacaagacatcacaagcagggttactccaggttccacttattctgtttctgcctgcgttggagtgtcagggtctcttcaaggctctgctgatgtcttggcaactctgaggctagaacaccaagattctgcagctacatataagcgcattggaataacttctgtatccaaagagagatgggacaaggtggagggctcattttcgttgtctagtatgccgaaccgagttgtcttttaccttgaagggccttcttctggaattgacttgcttataaaatcagtggtgataacttgtcaaagtgcaaatggaaaagagagagtggacagggaacacatagctgctggtgatgaaaatatcatcctcaatcccatatttgatgatggattgaaaaattgggctgggagaggttgcaagattgtcttacacgactctatggctgatgggaagatagttccacagtctgggaagtactttgtatctgcaacagagcgtacccagacttggaacgggattcagcaagaagttactggaaggctacaaagaaaacttgcttatgaggtcactgcattggttcgtatatttggtaacaatgtcagcagcactgacgtccggatcacgctgtggacccaaacgccggatctccgtgagcagtacataggcgtagccaacgtgcaagcaacagacaaggactggacacaaatgcaggggaagtttctcttgaatggttccccgtcaaaagttatcatctacattgaaggtccacctgccggtactgatattcttgtgaacagcttaacagtaaagcatgcggcaaaagctgctccttctcctccaccagttattcagaatccagcttttggagtaaatataataggaaacagtgacctagataatgggactaatgaatggttcccccttggtaactgcactttgagtgttcgagctggttcaccgcacattcttccctcctcagcaagagattcgcttgggcctcatgagcctttgagtggcagttacatccttgtgacaaatcgcacacagacttggatgggccctgctcagatgatcactgataagctcaaactctttttgacatatcaagtttccgcttgggtacggataggttctggtgcgagtggtcctcaaaatattaatgttgcacttggtgtggacaaccaatgggtcaatggtgggcaagtcgaggctaatgatgacagatggcatgaacttagtggatcattcagaattgaaaagcaaccgtcaaaggtcatggtctacatccagggtcctgctccaggtgttgacttgatggttgcaggggttcaaatattcccagttgatcgacaagcgaggtttaaccatctgaaacatctgactgataagctccgtaagcgtgatgttgtcctgaagttttctggtgcggattcaagcagcttggttggtgccaccgtgattgtcaaacagacacaaaatagttttccgtttggctcgtgcataagcagaacaaacatagataacgaagattttgtcgatttcttcgtgaagaacttcaactggactgtttttgggaatgaattgaagtggtactggacggagccacaacagggaaattttaactaccgggatgctgatgagatgcttgacttgtgtaagagccatggcatagaaaccagaggccactgtatcttttgggaagtggagagcacggttcaagcgtgggtccaatccctcaacaacaatgacttgatgagcgctgttcaaaaccgtttaaacgggcttctttctcgctacaagggcaagttcagtcactatgatgtgaacaacgagatgctacacggatcattctatcaaggtagattaggaaaagatatccgagcaaatatgtttaagactgcaaaccaattagatccatctgccacactatttgtgaatgattatcatgtggaagatgggtgcgacaccaagtcatgccctgagggctacatagaacacattcttggtctacaggaacaaggcgcaccagtcggcggaatcgggattcaagggcatatagataatccagtgggaccaatcattaattcggctttggataagctgggcatcctcggccttccaatctggttcactgagcttgatgtgtcctctgttaacgagtacgtaagagctgatgatctggaggtcatgctccgagaagcatttgcacatcctgcagtagatgggataatgctgtggggattctgggagctgtttatgagccgagacaacgcgcacctggtcaatgcggagggggatgtcaatgaagccggcaagagatacctggctctcaggaaagagtggtcgtctcatgctcacggacatgtcaacgaacaaggcgagtacacgttcagaggattccacgggacgtacgacgtcctcatcgttacctcttctaaacggactacaaagagcatcgtcgttgataagggcgagtccccgctcgtcgtgcctataagtctttgagtcacacgtgagtgttgccactgaacatggtgttacttgtaaattattgatcatactgcgtgatggaataagggggcacatgactgtacatagcatggtgtgcaaaggggattgattgatgtctatattgtaattttaaagcccaaaaaaataagatatgattgctgctaaaaaaaaaa

SEQ ID NO: 160 - DNA, 2786 bp, Eucalyptus grandis
acatataaaaaactgaggatgatcagcttcatcgggtcaccatttcaggaaatgaggaaatgcctgtttctaggttgacaggctgtaattcacatgagacctttgctcttctgacatgactatgattcttccaggcttttctaggactgctccaattgctggagcgatgagaacttcgccaggattcaacatgttcttgtttctttctctcgcatttgcattgctgtccttaggatctgccatttcagggcaaatcatgcagactgtcttcgatgattattacgattcatcagcgacaacacagtgtttggcagagccagggagtcttatgtatggaggtggggtcatactgaacccagagttcatccatggcacttccggatggactgtgcttggggaaggagcgaccgaagtgcgcatatcgcataccaacaacaggttcatggtggcacgcgataggaaacgcccaacagacagtttctctcagaaagtccaactcgagaagggaatgttctatgcattttccgcttgggtacaagccagtcaaggaagcgagacggtagcggtggtgtttcgaactagagatggcaagtttgtccgtggaggcagtgtcgtggccaagcaggggtgctggtctttgctgaaaggaggcatcgccgcaaattcttcgagcccagctgatgttcttttcgagagcaagaatacttcgacagagatatgggtcgacaatgtcgcgttgcagtcgttctcaaagaagcaatggaggactcaccaagaagaaagcatagagaaggtaacaagaaaagtttgtgccaagttagttcgaaaaacttgaaggaccgtcgcgaacttcgatctcgcaggtacggaagagcacagtgaggttccagataacttctgcgaacgaaagaggactcggggtcggaggagccaatgttctcatcaaacagatcaaaccgggctttccattcgggtgcggcatgaacttccacatcctcgagagcgccgattaccagaactggttcgcatcgcgattcagatacgccactttcaccaacgcaatgaagtggtacagcacggagaaggaacaaggccaagaggactactcagtggccgacgcaatgctgaagttcgtgcaagataacaacatttcgatccgaggccacaatgtcttctgggacgatcccaagtaccagcccgattgggtcaggaccctttcacccgatgatctgcgaaaggcagcagagaagaggatcaattctgtcgtctcgcgatacgcaggagaactgattgcctgggatgtggtcaatgagaacctgcacttcagcttcttcgaggacaacctcggggaaaatgcttcctcgatgtattactcgatggcatacaagctcgacccgaccccgagaatgttcctgaacgagtacaacaccatcgagtacagcggggacgagaaggtgagcccggggaactacaagaagaggttccaggagatatttacgtaccctgggaacgaggacataccggccggaataggagtgcaaggccatttcggcgccggccagccaaactcggcttacatgagatcaggcctggacattctggccacaactggtttgcccatttggctcacagaagtgtcagtggctccaggagctaaccaggtattggcatttcttagaaaagatgtgatcaactgatcatgcccttggcagcttgcccggtctggcaggccccaaaggcaaaataggccgggtcgggcgagcgattctctttttgcggctggcccggcccgctcaccttggcccgttcgaaccctatcaaattcatatttgcatatttcgataattttttcaataggagaagagcataaacatgacttaaagcttctggccattagtcaattgaagacttgaggccatgataggatcttgaacccgccgtcgatggaatttagacattggaaatgacatgtagcaaccgatgcctgaattccaccgatggagacctcgagaagcgagtgaagctttttctaagatcttcaattgaacaaaatgaaacttgacaaacggccaagaggttaagtcctgattttgcatttatctccatttttcaataaatggaagtgcaaatatcaaaagacaggcactctacaatgcattgtaaggttttctggaatattgcaggcccagtacttggaggaggtgctcagggaggcttactcccatcccggcgtggaaggtatcataatgttcgccggccctgcatatgccggcttcaactccaccgcgttggcggacatgaacttcgacaacacaccgaccggggacgtcgtggaccagctgatacaggaatggagattcaaggacttggcggctcgtgccgacgacgaagggttcttcagcaccaaactgctccatggagagtatgagatcaccatcaccgatccaatctcaaattcctcttccacttcaagatttcaagtgaccaaagatagcttcaagataatttaccattttcacatgtgatgaattgtcagctacaagctcctttggagctagggatagggctttgattattgattgatagttgctaaattaagattaatcagagagggtacatataagggcccttaaatgccaagtttttttttttttggtcaaaaaatgcattgcatatgtaatcatgacctagaaagatcatgtcgatattgtgtaaataatgtttggtcatttttcgggcgctcttgcaatgtaatattgtaccatctaccgatcccaaaaaaaaaa

SEQ ID NO: 161 - DNA, 2000 bp, Eucalyptus grandis
ctctctctctccttctctccctcgctgcttattcaatcacttttccaccagagaaaggaaaagaacaaaagaagatgaaagacgcctctgctttcatcagtttcttggttttcttcctcctcttgtgctctccttggattgctgcttccctcgatgacccccaatatgatcacactgcttacaccaagtgcaaggaggagccagagaagccgctctacaatggaggcatactcgagcctcatcagcttccacaatttgcttcttcttctccagccctcctgctgcacaatctcaccgcctcaactaaatactccttctccagttgggtgaaaatagagagttcggattcagattctgctcttgtcacagccagtttgaggacaaaccatgaaacatacgattgcatagggactgtcgccgcgaaaagtggttgctggtcatttctcaagggcggattcactttggatttgccatcaaactccgctacactgtcctttgagagctcagatggcagatatatcgccatagcaatctctagcacttcgctccaaccattcactgatcagcaatggaggagaaatcagcaagacatgataaacaaagtaaggaagcgcgccgtgatgatccatgtatcaaatcataacggagacaggttacaaggagtggaaattaatgttaagcaagtctacaaagatttcccatttggatctgccatagcgaagaccattcttgggaatgaggcttatcagaactggtttgtcgagcgatttaatgcagcagtatttgagaatgaactcaagtggtacgcaactgagccctaccccggacagattaactacactatcgcagatgagatgctggagttcatccgagcaaaccggattgtcaccagaggccacaacatcttctgggaggacccaaaatacaatcctgagtgggtccaaaatctctcggggccccaacttgagtccgcagtggacaccaggatccaaagcctgatgagtcgatacagggaagaattcgtacactgggacgtgagtaatgagatgctccacttcgatttctacgagcggcggctcgggcccaacgcaacgctgcatttcttccaaacggcacatgagtcggatccgctggccaccctcttcatgaacgagttcaatgtgctggagacctgtagcgatgccaattccaccgtggacagctacatctcgaggatgagagacctcaagcgcggcggcgtttcaatggacggaattggcttggagggtcacttcacggtgccaaacctgcccttaatgagagctatcctagacaaactgggcacactcaggcttccgatgtggctaaccgaggtcgacattagcagcaccctcagtaaggagtcacaggcccttcatttggaagaagttttaagagaaggcttttctcatccttccttaaacggtatcatgctctggaccgccctccatcccaacgggtgctaccaaatgtgcttgacagacgctgacttccgaaaccttccggctggcgacgtggcggacagtcttctgggggaatggaggaccaaggaggtcaatgggaagaccaacgagcacgggtcgtacagttttgagggtttccttggcgagtacgaagtaagcgtcatgcatggagatcaaactgcaaattcaacatttgcactatctcaaggtgttgaaaccaggcatgtgaccattcttttgtgacttctagagaatctgaaggatggatactccagaggttacaaggcactgactagaatcaaaaaccttttcttttctctttctttttttttcttatttttccacaatttgcatgctgaaatctctaatgattgtataagcataggattcccagtgacaagagaactagtcatgcctctgcttctgaattagatcctttctcgccatatgcagagcaatggtgattctccaaaatttacatatatcccaaacttactccatttggctttaaaaaaaaaa

SEQ ID NO: 162 - DNA, 3251 bp, Eucalyptus grandis
ctctctcttctctccatctccgacgcccgattcctcagccccgccatcatttttcacgagaagaaacctcatcgacgagcaacccaaaaccacatccatttcagccatcgacactctgcttgctgactcggtctctgtccccccctccccttcctctctctctctctctctctctctctctctaggcgttcagacaagttggcagtagcatccaaacaaggaaaagcagaccccccccctctttgtttatcgaggagagacagagagaaacccaatcacgggctcgtctagtgctttatccactagtgcactattgctagtgtatgtatagacccattaagattctccctgttggcatcctccatagcaagcgcctcattcactgcagcctcgtttttcttcctcctgttcctcgtccgatagcccatcggcaatcacgggctgctacaaaacaaacgcctcccccctgttcagcaccacgtcccagccttatataacccacgtattgctcgtctttcctccgtgtcgcggggcattgcatttgttcagagagttgctctcgggaggtcgcgcgccctcccatgatgacccctgcccagaacagagcgccgaaggtgtcctctgttttgctctgcctctgctgcattcatgcgttcttctcgtgcgccgtccggctggtcgcgggccagacgcccaagccggtattcgcctgcgacgtggacggcaacccgagcctcgccgccttcgggttctgcaacacgtcgtggggggtcgaggcgcgggtggcggacctggtgcagcggctcaccctgcaggagaaggtcgggttcctggtgagcggcgccggcaatgtggaccgcctggggatccccaagtacgagtggtggtcggaggcgctgcatggggtgtcgtacgtcgggcccgggaccaagttctcgagcctcgtccccggagcgaccagcttcccccaggtgatcctgacggcggcgtcgttcaatgccaccctgttcgagaccatcgggaaggtggtttcgacagaagcccgggcgatgcacaatgtggggttagccggattaacgttttggtccccaaatgtcaacatattcagagacccgagatgggggcggggccaggagactccgggggaagacccgctgctttcgagcaagtatgcgtcaggttatgtccgaggcctacaaaagagcgacgacggaaatgcggaccggcttaaggttgctgcctgttgcaaacattatactgcatatgatgtcgataactggaagggtgtcaatcgccttaccttcaacgctgtggtaacacaacaagatttagatgatacgtttcaaccgccattcaagagttgtgtccttgacggcaatgttgcgagtgtgatgtgctcctacaaccaggttaatggtaagccgacatgtgcagacccggaccttcttgctgggaccatccgaggaaaatggaaattgaacggatacatcgtttcggattgcgattcggtggaagttttgtatgacaaacaacactatactaaaacaccagaagaggctgcagctaaggccattttggcagggttggatctcaattgcggatctttccttggccaacacaccgaagctgccgtgaaaggtggattgttgaatgaatccgcggtagacaaggccatctctaataattttgccacgctgatgaggctcgggttctttgacggcgatccgaggaagcagttgtatggaaagctcggcccggacgacgtgtgcacaccgagcaaccaggagctggcccgcgaagctgcaaggcaagggattgtgttgcttaagaacacggcaggatcattgcccttgtcctcgaccgccataaagtccttggcggtgattggaccaaacgccaatgtcacgaagaccatgatcgggaactacgaaggcactccttgcaagtacgtgacgcctttgcaaggcctagcagccatcgtttcgacaatgtacgtggccggctgtgcggatgtaggatgcagcacggcccagacagacgacgcgaagaaagctgcggcttcggcagatgcaacggtgcttgttatgggcgccgaccagtcgattgagagggaggattttgaccgggtcaacctcaacctcccaggccagcagtcgctcttggtctcagaagtggcgaacgtgtcgaaggggcctgtggtcctcgtgatcatgtctgggggagggatggatgtatccttcgccaaggacaatgcaaagataacgagcattttgtgggttggctaccccggcgaagccggcggcgctgcaatggcggacgtgatttttggggaccataatcctagtggaagattgccgatgacgtggtatccgcaatcatacgtggacgccgtcccaatgacaaatatgaacatgaggcccgacccagccacgggctaccccggcaggacataccgcttctacaccgggccgactgtgtactcatttggggatgggctgagctactccagcttcagccacggtcaagtccaagtgccacagctcgtgtccgtgcccttagatgagggccacatttgccactcgtcggcatgcgaatcgttggaagccaagagcgaaacatgctcgaatctggtcttcgacgtgcatctgaacgtcaagaacgtgggaaggttcagcggcagccacacggtgttcttgttcagcagccctccatcggtgcacaggtcgccccagaagcacctgctgggctttgagaaggtgttcttggcctcacaaagtgaggcgcaagtgcagttcaaggtcgacgtttgcaaggatctgagcgtggtcgacgagctcggtggccggaaggtcgccctggggacgcatgtcctccacgtcggcgacctgaagcatgcgttgagcgtgcagattggatcgtccgggctctccctgagcccgccgagacatttctgaataaagaaatcaaagtgataaacgtttgagagatgttcgcaagaactccctctcaaccgatcgtcatgtagccaaactgttcaaaagcaaattgaagtttcgactaccatgaagcaactcacctttgtttttgatttacatcattgaaaataagaaaacacaacaggccaatttttattagagaagctgatggtaaaatcatgattgatgcttccccattaaaatgctagagatttatcaatacttttgtaaaagtattaatttgtatttggttgtatcaaagttacaaaaaaaaaa

SEQ ID NO: 163 - DNA, 3037 bp, Eucalyptus grandis
gccccctctctcttctctccatctccgacgcccgattcctcagccccgccttcatttttcacgagaagaaacctcatcgacgagcaacccaaaaccacatccatttcagccatcgacactctgcttgctgactcggtctctgtccccccctccccttcctctctctctctctctctctctctctctctaggcgttcagacaagttggcagtagcatccaaacaaggaaaagcagacccccccctctttgtttatcgaggagagacagagagaaacccaatcacgggctcgtctagtgctttatccactagtgcactgttgctagtgtatgtatagacccattaagattctccctgttggcatcctccatagcaagcgcctcattcactgcagcctcgtttttcttcctcctgttcctcgtccgatagcccatcggcaatcacgggctgctacaaaacaaacgcctcccccctgttcagcaccacgtcccagccttatataacccacgtattgctcgtctttcctccgtgtcgcggggcattgcatttgttcagagagttgctctcgggaggtcgcgcgccctcccatgatgacccctgcccagaacagagcgccgaaggtgtcctctgttttgctctgcctctgctgcattcatgcgttcttctcgtgcgccgtccggctggtcgcgggccagacgcccaagccggtattcgcctgcgacgtggacggcaacccgagcctcgccgccttcgggttctgcaacacgtcctggggggtcgaggcgcgggtggcggacctggtgcagcggctcaccttgcaggagaaggtcgggttcctggtgagcggcgccggcaatgtggaccgcctggggatccccaagtacgagtggtggtcggaggcgctgcatggggtgtcgtacgtcgggcccgggaccaagttctcgagcctcgtccccggagcgaccagcttcccccaggtgatcctgacggcggcgtcgttcaatgccaccctgttcgagaccatcgggaaggtggtttcgacagaagcccgggcaatgcacaatgtggggttagccggattaacgttttggtccccaaatgtcaacatattcagagacccgagatgggggcggggccaggagactccgggggaagacccgctgctttcgagcaagtatgcggcaggttatgtccgaggcctacaaaagagcgacgacggaaatgcggaccggcttaaggttgctgcgtgttgcaaacattatactgcatatgacgtcgataactggaagggtgtcaatcgccttaccttcaacgctgtggtaacacaacaagatttagatgatacgtttcaaccgccattcaagagttgtgtccttgacggcaatgttgcgagtgtgatgtgctcctacaaccaggttaatggtaagccgacatgtgcagacccggaccttcttgctgggaccatccgaggaaaatggaaattgaacggatacatcgtttcggattgcgattcggtggaagttttgtatgacaaacaacactatactaaaacaccagaagaggctgcagctaaggccattttggcagggttggatctcaattgcggatctttccttggccaacacaccgaagctgccgtgaaaggtggattgttgaatgaatccgcggtagacaaggccatctctaataattttgccacgctgatgaggctcgggttctttgacggcgatccgaggaagcagttgtatggaaagctcggcccggacgacgtgtgcacaccgagcaaccaggagctggcccgcgaagctgcaaggcaagggattgtgttgcttaagaacacggcaggatcattgcccttgtcctcgaccgccataaagtccttggcggtgattggaccaaacgccaatgtcacgaagaccatgatcgggaactacgaaggcactccttgcaagtacgtgacgcctttgcaaggcctagcagccatcgtttcgacaatgtacgtggccggctgtgcggatgtaggatgcagcacggcccagacagacgacgcgaagaaagctgcggcttcggcagatgcaacggtgcttgtgatgggcgccgaccagtcgattgagagggaggattttgaccgggtcaacctcaacctcccaggccagcagtcgctcttggtctcagaagtggcgaacgtgtcgaaggggcctgtggtcctcgtgatcatgtctgggggagggatggatgtatccttcgccaaggacaatgcaaagataacgagcattttgtgggttggctaccccggcgaagccggcggcgctgcaatggcggacgtgatttttggggaccataatcctagtggaagattgccgatgacgtggtatccgcaatcatacgtggacgccgtcccaatgacaaatatgaacatgaggcccgacccagccacgggctaccccggcaggacataccgcttctacaccgggccgactgtgtactcatttggggatgggctgagctactccagcgtcagccacggtcaagtccaagcgccacagctcgtgtccgtgcccttagatgagggccacatttgccactcgtcggcatgcgaatcgttggaagccaagagcgaaacatgctcgaatctggtcttcgacgtgcatctgaacgtcaagaacgtgggaaggttcagcggcagccacacggtgttcttgttcagcagccctccatcggtgcacaggtcgccccagaagcacctgctgggctttgagaaggtgttcttggcctcacaaagtgaggcgcaagtgcagttcaaggtcgacgtttgcaaggatctgagcgtggtcgacgagctcggcggccggaaggtcgccctggggacgcatgtcctccacgtcggcgacctgaagcatgcgttgagcgtgcagattggatcgtccgggctctccctgagcccgccgagacatttctgaataaagaaatcaaagtgataaacgtttgagagatgttcgcaagaactccctctcaaccgatcctcatgtaaaaaaaaaa

SEQ ID NO: 164 - DNA, 2605 bp, Eucalyptus grandis
ccaaaaccgccacaccatgaccggaaccgccctccccgccgccgccgccggcacggcgaccctcctcctcctcctcctcatctccggcggcatcggccgcctcgccgtcggcgcccgggagccgttcgcctgcgacccgaaggacgagaggacgaggggcttcccgttctgccaggcctcctcgccggtcccggagagggcgagggacctggtcgggcggctcacattgcaagagaaggcgaagctgctcgggaacgacgccgccgccgtcccgcggctggggatcaagggctacgagtggtggtcggaggcgctccacggggtgtccaacgtggggccggggacccggttcggcggcgacttccccggcgccaccagcttccctcaagtgatcacgaccgccgcatccttcaacgcatcgctctgggaagcgattggacaggtagtgtcggacgaggcaagagccatgtacaacggaggcatgggcgggctcacctactggagccccaacatcaacatcctacgggacccgcgctggggccggggccaagagactcccggcgaggaccctgtcgtcgttggccagtacgccgccagctatgtgcgggggttgcaaggggccgacggcaatggtggcggtcggctcaaggtggcggcttgttgcaagcacttcacagcctatgatctcgataactggaacggggtcgatcgctatcacttcaacgcacgggtgagcaaacaggacatggaggatacgttcagtgtcccgttccggatgtgcgtgatggaaggcaaggttgccagcgtgatgtgctcttacaatcaggtcaacggcatcccgacctgtgccgacccgaacctcctcaggaaaaccgtccgcggcgcatggcggctcgacgggtacgttgtctcggattgcgattcggtcggggtattctatggcaaccaacattatacatccacgccgcagcaggccgtggccgatgcgattaaagcaggcctggatttggactgcggcccattcctcgggaagcacacggaggaggcggtgagaggcggcctgatgaacgaagccgacatcgacggtgctttgctcaatacgctagcggtccagatgcggctggggatgttcgatggcgagccgtcggcccagccctacgggacactcggcccgaaggatgtgtgcactccggcccatcaggagctcgccctcgaagccgccaggcaaggcatcgtcctcctcaagaaccagggaccggccctccccctctcccctcgccgccaccgtgccgtcgccatcatcggccccaactcagacgtcaccgtcacgatgattgggaactatgccggtgttgcgtgtggatatacgactcccctccaaggaatcggcaagtacacgaagaccatacaccaacaaggttgtgcggacgtagcttgcagcgacgacaagctgttcgaaggagcgatcaaggcggcgcgtggagccgacgcgacggtcttggtgatggggctcgaccagagcatcgaggcggagttcaaggacagggacagtctcctcttgccgggacggcagcaagagctcgtgtcgaaggtggccatggcctccaagggtccaactgtgctggtcttgatgtccggtgggcccgtcgacatctccttcgctaagaacgatccgcgggttgccgccatactgtgggccggttaccccggccaggccggtggcacggccatcgctgatatcttgttcggagcaactaacccaggaggaaaactgcctatgacatggtacccacaagattacctagcgagcgtacccatgaccgtgatggacatgaggcccaccagatcgaacctctacccgggccggacctaccgattctatggaggcccggtggtgtacccgttcggccacgggctgagctacacccacttcgtccacacgctcgcttctgccccctcgacggtggttgtccccctcgccggccgccgccccgcgaatgccaccatgggccccgggaaggcagtcagggtcacacacgcccggtgtgccaggctctcactcagggttcagctggacgtccagaacgccggggcaagggacggggcccacacggtgctcgtgttctcgacgccccccgaggacggcggggcgcgctgggcgccgccgcgcagtcagctcgtggggttccagagggtccatgtggcggcgggggcccgcgagagggtcgggatcaacatccacgtgtgcaagtccctgagcgtggtggacggggccggggtgaggaggattccgatgggggagcaccggcttcagattggggatgtcgtgcactcggtgtcgcttcaggccgagccgttaagagtgatctagtcttgagaggaattcgcaaattttgggggcgtcatcgcaagatgattagccgccaggggctttgattctttcaattggcattgtattgtacctaggtcatcctcacattgggaattaagaaggggaatgaagaaatataaatggcatagaatatatacagacggctctaaaatggggtactctttctttatttatggaaaatgatgaatatcacgaattccttcaaaaaaaaaa

SEQ ID NO: 165 - DNA, 2586 bp, Eucalyptus grandis
agccactctcccacactctcaccgtctccaaaaaaacccagccaagatgagaaaccgccaagtccaaatcctctctctgctcatcaccttcgcctccgccgccaccctcctctccactcccgccgctgcccagccgccgccgttctcgtgcgacccatcgagcccctccaccaagtccttccccttctgcaaggcctcgctccccatcagcaagcgcgcccaggacctcgtctccaggctcacattggacgagaagatctcgcagctggtcagctccaccccggccatcccccggctcggcgtccccgcctacgagtggtggtccgagtcccttcacggcgtctccaacgccggccgcggcatccacttcgacggcaccatcaagtccgccaccagcttcccccaggtcatcctcaccgccgcctccttcgacgccgacctctggtaccgcatcggccaggtgatagggaccgaggcgagggcggtgtacaacgcggggcaggcgacggggatgacgttctgggcgcccaacatcaacatattcagagacccgaggtgggggagagggcaggagacgcccggcgaggacccgctggtcaccggaaagtacgccgtctcgtacgtgcgaggcgtccagggcgaccgcccccagggcggagggaagtcccgagggggtctccaggcgtccgcttgctgcaagcacttcaccgcctacgatctggaccgctggaagggcgtggatcgttacgacttcgatgctcaggtgacggcacaagacatggcggatacgttccagccaccatttcagaagtgcattcaggacgggaaggctagtgggatcatgtgcgcttataaccgggtcaacggcgtccctagctgcgccgactacaatcttctctccaacattgcccgtcgtcagtggtctttccacgggtacataacatcggattgcgatgctgtatccatcatgtatgacaatcaaaaatacgccaagacgcctgaggatgccgttgccgatgccctcaaagctggcatggatgtcaactgtggaacctatctgcaaaatcataccaaatctgctgttgagcaaaggaaagtgtcagtatccgagatagacagagcacttcacaacctcttctcggtaagaatgaggctaggactcttcaatggcgaccccaagaaacagccatttggcaacataggccctgatcaggtctgctcccaaaagcatcaagatttggctctcgaggctgctcgaagcggcatcgtgcttctgaagaacaaagaaaagcacctacctcttcagagatcgaagtctgcatcgcttgctgtaataggccccaatgccaacaaggcctcgaacctgctcgggaactatgcaggaccgccatgcaagtctgtgacgctgctgcaggctctgcagagttatgtgaaggacacaaggtatcagccgggttgtgacgatgtagtgtgttcgtcaccgcagattgcccaggctgtggaagtagcgaaagcagcagatcacgtggtcctgatcatggggttagatcaaactcaagagagggaggacttcgatcgtgtggatttggtccttcctggcaggcaacaggagttcatcacgaccgtcgcccaggctgcaaagaagccagtcatcttggtgattctttgtggaggtcctgttgacataagattcgccagagatgatcagaacatcggaagcatcttgtgggccggttatcctggtgaggccggcgggatggcattgtcagaaatcatctttggtgaacataatcctggagggagattgccagtgacttggtacccgcaagaattcactagagtgccaatgactgacatgaggatgaggcctgaaccatccactggctatcctgggcgtacataccggttctaccaaggccagtcgatttttgagtatggacacgggcttagctacacagaatattcttataagttcatatctgttaccagggaacttttctacctaagccaatccgctaaatctcaacctgatgaagcctcagacgcctcccctcggtacagactagtttcagatttgggagcagatttttgcaagaagagcaattttgtggccacggtcaaagtcaagaaccatggcgacatggtgggcaagcacccagtgttgctctttgtgaggcatgcaaagccaagcagcgggagcccgatgaagcagctggtggccttccagagtgtggaactgaaggggggcgaaaccatgaaggtgcaattggcattgaacccctgcgaccacctgagccgagccaatgaaaatggtgtgatgatattagaagaagggtggcgcttcttggaggtgggagatcaagagtacccgatcaacgtgatggcctgatacgcgaaattgggcggttgttcatcttgcgttgttaaggattttatagcttgttgcatccttctattaacgtttcaattggcaagtgtaacaagaaaatgttcgaacggcaacttctccctatttgcatgagaaaaggatcaataaggattaagcatcaatgaattttcaagcagttttccattgtaaaaaaaaaa

SEQ ID NO: 166 - DNA, 2330 bp, Eucalyptus grandis
gcctcgtgccgcgccctctatcttcctccctacccatcatcgccaaacgacgtctctgtcgctccaccacgcgcagctcgcgacagagagaaacagagagaagaagggggagaagaattcccgaacccaagtggggaaaaaaacgatcttttttcaggctctctctcgctctgccttagactacggacccagaaggacggtttggggtgatgagcgtgatggggagatactccgtacccattaaggcgttcctgctgatatgctgcttggcggctgtcacgacggaggccgagtacgtgaagtacagagacgcgaagcagccgatgggtgctcgggtcagggacttgatgcgcaggatgacgctggccgagaagattggccagatgacccagatcgagcgcagcgttgccacgcccgacgtcatgaagaactacttcattgggagcgtgttgagtggtggagggagtgtgccggcgccgaaggcctcgccggagacctgggtgaatgcggtgaacgagatccaaaaggctgctctttccacccgactcgggatcccgatgatttacgggatcgacgcggttcacggtcacaacaatgtctacaatgccaccattttcccgcacaatgtcggcctcggtgtcaccagagatcctgtgctactcaagaagattggcgatgccacggcacttgaagttagagcaaccggtattccttacgctttcgcgccgtgcattgcggtgtgccgagatccgagatggggtcggtgctacgaaagctacagcgaggatcaccggatcgtccggatgttgaccgagatcatacccggtctacaaggagaccttcctgccaattccccaaagggtgttccgtttgtcgccggaaagaacaaggtcgcggcctgtgccaagcactttgtgggagacgggggcacgacaaagggcataaacgagaacaacaccgtcgttgattacaatgggctgctcagcattcacatgccggcgtatttggatgccattaggaagggcgtcgccacggtcatggtgtcgtattcgagctggaacggcaagaagatgcacgcgaacggtgatcttgttactgggttcctgaaaaacaagctaaaattcaagggtttcgtcatatcggattgggagggcattgacaggataacgtctcctcctcatgcgaactactcttactctgttcaagccggagtcggtgcaggaatcgacatggtcatggtgccttacaaggtcactgagttccttgatgacctgactaaacaggtgcagaacaacgtaatcccgatgagtcggatcgacgatgccgtgaagaggatcttgagagttaaatttgtcatgggacttttcgataacccactggccgataacagcctggccaaccaagtaggaagcccggaacatagagaattggcaagggaagctgtgagaaaatcactggtgcttctgaagaacggtaaatcttcgggaaagccattgattccgcttcctaagaaagcgcagaagatacttgtcgcgggaagtcatgccgacaacttgggcaatcaatgtggaggttggacaattgcatggcaaggccttaacggcaatgatctcaccaccggtaccacgatcctcaatgcggtcaagagcacggtccatcctgacactcaggtggtctacaacgagaaccctgatgcgaacttcgtgaagtccaacaactttgcatatgccatcgtcgtcgtaggagagccgccttatgcagagacatttggcgacagcttgaacttgaccatccccgagcccgggccaagcaccatccgcaatgtgtgtgggtcagtcaagtgtgtggtggttgtcatctcaggccgccccgttgtcattgagccctatgtctcgaacatagatgcactggtggccgcttggcttcccgggaccgaaggccagggagttgcagatctcctgtttggtgactatggtttcactggcaagcttgcacggacatggttcaggagcgtcgaccagctgccgatgaatgtcggggacccgcattacgacccgctctacccatttgggtttggcctgacgaccaagggcaccaaggagagcgatcctacatattcttgaaaagagtgacgtatttgtataatttatgttcccttcatcagtgagaagagtgaaatagtatcttaatttttttccgattgttataagatcacactcattagtcagtggtgagatcaaaatgggtgttcaactgtttgtttcagtcaattacacaaaaagacagaacaactactctcagcagcttcgtcagacttcctaaaaaaaaaa

SEQ ID NO: 167 - DNA, 1708 bp, Eucalyptus grandis
gtgtctcatttaatctgacagcaacgaagagagccagaaatggcacactgtcgtcaccatccactcgtgctgctttgttcactctttgtgttccttccctcgatcctcgcccagaccgccgacttcaacttgcctctcagggctatcaacctcggaaattggctcgtcactgaggggtggatgatgccttctcggttcgatgggctaattggacagctcttggatggggctcaagtgcagttcaagtcgacgcagctgaaaaaattcctgtgcgctgaaggcgccaacatagtcatcaatcgcgaccgggccgctggctgggaaactttcaggctgtggaggatttccgacactaaattcaacatcagagctttcaacaagaatttcgttggattgaaagacaaaaaaatagtgattgcagaagtttatggtactccgagtgcctcggaaacttttgaaattataaggaacccgaaccgtcccaatcgagtgcgactccgagcatctaatgagttgtttctccaggcaaaaacactgacatcagtgacagcagattataatggagatacgaattggaatgataatgacccgtccatcttcgatataaacattgttggtggcttacaaggcgaataccagataacaaatggctatggccccagtactgccccacaactcttacgggatcattggaataattacattaccgagcaggacttccgatttatggcgaccaataatgtaactgccgtgaggattccggtaggatggtggattgcatatgatccaacaccgccgaagccttttgtgggaggctcgctgtatgcactggacagggcttttacatgggcagagaattatcgtatgaaggtaatagttgatctccatgctgctccagggtcgcaaaacgccgaatctcatagtgcgacaagggatggatttgtggaatggggtgactcttacattcaggagactgtgaaagttatagaattcctggcagcaagatattgcaaccgttcagcattggtcgcaatcgagctgatgaacgagcctcgagccccagatgtcaagttgaatgatcttattgattactaccggttaggttatgaggctgtgaggaggtacaccatggatgcttatgtgatcctgtccaaccggttgggaccagcagacccactagagctctttcaatttgtgagaggcttgagccgagtggttattgatgtacattactacaacctctacgatccgaagtttaagcagtggaatctacagcagaacattggctacatctatgtcgatagagagaatgatctgagcaaaataacccaaaaaaggggccccttgagctttgttggggaatggacctccgcattggacttcgatggggcaacaaaggaggattcggggagattcgccaaggcccagcaagacgtgtacaggcaggccactttcgggtgggcgtatcggtcttataagtgccactacgatacctggagtctcgaacagatgattgaagacggtcttataaagatcgtagcttgattctgttccgtagttcgtcatgctcatcaagcgagtcatgtcatcatgagtactaagaataaaaggtttcggagcttgtctgcgggatgtatgtgtcataaaaagttgccattatggtgacaataatagaattaaataaaactggacttgagcaaaaaaaaaa

SEQ ID NO: 168 - DNA, 2297 bp, Eucalyptus grandis
accacctaatcctcccaagccaaccacgccgatcgtcgtgcctcggatcggataagcttcgggagtcctgctttctcgatcgatcggatccggcgggcggccggttcgcaggggtgcagccgagagatgggttcggccgaggacgcgaggtgcgtgtacaaggaccccaacgccgccatcgaggatcgagtcaacgacttgctctcccggatgaccctgcaggagaaggtcggccagatgacccaaatcgagaggcgcgtcgccactccctccgtgctctccggcctctccatcgggagtatactcagtgctggaggcagtgggccatttggggtaataggcagtgagtcatctaagcaagcattgtcgtcggattgggccgacatggtggatggattccaaaaggcggcgctggagtcccgcctgggaataccgcttatttacgggattgatgcagttcatggcaacaatagtatatacggcgccacgatattccctcacaacattggccttggagccactagagatgcggagctagttcggaggattggggtcgcaactgcacttgaagtcagagcaagtggcattccttatacttttgctccatgtgtggctgtgctgaaagatcccagatggggaagatcttatgagagctacagcgaagacactgatatagttagaaagatgactccaatagtagcaggtttgcagggccagccaccccaagggcacccaaagggctatcctttcgtagctggaagaaacaatgttattgcttgtgccaagcattttgttggagatggaggaactgaaagaggtgtaaatgaggggaacaccgtaacgtcttatgaagatctagaaaggatacatatggctccctatttggattgtatctcccaaggtgtttgcacagtcatggcatcctactctagctggaatgggcgcaggctgcattctgactattttctcctgacagaggtcttgaaagataagttaggttttaagggctttgtcatttcagactgggaaggacttgaccgactcagtcaacctcatggctcaaactaccgtcagagtatttctctggcagttaatgctgggattgacatgattatggtgccttttagacatgaacaatttgcagaggatttgacagccttggctgaatcaggggaagtaccaatgtccagaatagatgatgccgttcaacggatactgagagtcaagtttgtatctggtctatttgagcatcctttttctgatagatcattgcttcagattgttggttgcaagtcgcatagagaattagcacgtgaagcagttcgaaagtcgttggtattgttgaagaatgggaaggatccaatgaaaccatttctcccattagataaaaatgcaaagaaaattctagttgcaggaagtcatgctgatgatctaggttatcaatgtggagggtggactgccacttggcatggaagcagtggcaggatcacaatcggtacgactatcttagatgcaatcaaggaagcagttggaggcaacacagaagtgatttacgagcaaaatccatctccttccacattagcgagtcatgattacacatttgctattgttgctgttggtgaaggtccttatgcagaaactcttggtgataaccccgaacttgcaatcccattcaacggaacggacgtgataaagtcagtcgccgagagaatacctacactcgtacttgtcgtctctggaagacccttggtcatagaaccacatgttctggagaagatagatgctcttgttgctgcttggttacctggaagcgaaggaacaggcatcacagatgtggtcttcggcgactatgatttcgaaggtcaattacccatctcgtggtttagaacggttgaacaagtgcctatggaccataaagctaattcttatgatcccttgttccccctgggtttcggattgaaatgcaagaaagaagcctgatgacgaggcaattcaatgagtgatgaagttaatgaccaacagagaagtagctggtccggtcgaaaaatgccttctgaactagatattagtgcgcgtttgcaagaataatcgcttcagatccaatgtcccctaaattcctgttgaaattctagaagctctgaactagatattagagcgcatttgcatgaataatcgcttcaggtccaatgtcccctaaattcctgttgaaattctagaagcgtcagagtggaaaagggaatcgtataatttgtatgctacttttccagaactgcggtttctcactgttgagtgattgt

SEQ ID NO: 169 - DNA, 2162 bp, Eucalyptus grandis
acacgaaccacgccgatcgtagtccctcgaatcggataagcttcgggagtcctgctttatcgatcgatcggatacggcgggcggctggttcgctgggagccgagtgagatgggttcggccgaggacgcgaggtgcgtgtacaaggaccccaacgccgccatcgaggatcgagtcaacgacttgctctcccggatgaccctgcaggagaaggtcggccagatgacccaaatcgagaggcgcgtcgccactccttccgtgctctccggcctctccatcgggagtgtacttagtggcggaggcagtgggccattggggctggcagaaagtgcgtcatctgagcgagcattgttgtccgattggaccgacatggtggatggattccaaaaggcggcgctggagtcccgcctgggaataccgcttatttacgggattgatgcagttcatggcaacaataatatatacggcgccacgatattccctcacaacattggccttggagccactagagatgcagagctggttcggaggattggggtcgcaactgcacttgaagtcagagcaagtggcattccttatacttttgctccatgtgtggctgtgctgaaagatcccagatggggaagatcttatgagagctacagtgaagacactgatatagtcaaaaagatgaccgcaatagtaacgggtttgcaagggcagccaccccaagggcacccaaagggctatcctttcgtagctggaagaaacaatgttattgcttgtgccaagcattttgttggagatggaggaaccgaaagaggtgtaaatgaggggaacactgtaacgtcttatgaagatctagaaaggatacatatggctccctatttggattgtatctcccaaggtgtttgcacagtcatggcatcctactctagctgcaatgggcgcaggctgcatactgactattttctcctgacagaggtcttgaaaaataagttaggttttaagggttttgtcatttcagactgggaagggcttgaccgactcagtcaacctcatggctcaaactaccgtcagagtatttctctggcagttaatgccgggattgacatgattatggtgccttttagacatgaacaatttgcagaggatttgatagccttggctgaatcaggggaagtaccaatttccagaatagatgatgcggttcaacggatactgagagtcaagtttgtatctggtctatttgagcatcctttttctgatagatcattgcttcagattgttggttgcaagtcgcatagagaattagcacgtgaagcagttcgaaagtcgttggtattgttgaaaaatgggaaggagcctacgaaaccatttctcccactagacaaaaatgcaaagaaaattctggttgcaggaagtcatgctgatgatctaggttatcaatgtggagggtggactgtcgcttggcatggaagcagtggcaggatcacaatcggtacgactatcttagatgcaatcaaggaagcagttggaggcaacacagaagtgatttacgagcaaaatccatctccttccacattagcaagtcatgattacactttcgccatcgttgctgttggtgaaggtccctatgcagaaactctgggtgataacgccgaacttgcaatcccattcaacggaacggacgtgataaagtcagtcgccgagagaatacctacactcgtacttgtcgtctctggaagacccttggtcatagaaccccatgttctggagaagatagatgctcttgttgctgcttggttacctggaagcgaaggaacaggcatcacagatgtggtcttcggcgactatgattttgaaggtcaattgccagtctcgtggtttagaacggttgaacaactgcccatggaccataaagctaattcttacgatcccttgttccccctgggtttcggattgaaatgcaagaaggaagcctgatgacgaggcaattcaatgagcgatgaaaataatgaccaacggagaagtagctcgtccggtcgaaaaatgccttctgaaccggatattactatattagtgtgtatttgcatgaataatcgcttcatatcttgttgtatgaaatgtagaacttcaactgacgatgcgacacaaatgcttattccattttcctaaaaaaaaaa

SEQ ID NO: 170 - DNA, 2398 bp, Eucalyptus grandis
acaacattttcgcgcattatttcgcttcactccaccacctaatcctcccacacgaaccacgccgatcgtagtccctcgaatcggataagcttcgggagtcctgctttatcgatcgatcggatacggcgggcggctggttcgctgggagccgagtgagatgggttcggccgaggacgcgaggtgcgtgtacaaggaccccaacgccgccatcgaggatcgagtcaacgacttgctctcccggatgaccctgcaggagaaggtcggtcagatgacccaaatcgagaggcgcgtcgccactccttccgtgctctccggcctctccatcgggagtgtacttagtggcggaggcagtgggccattggggctggcagaaagtgcgtcatctgagcgagcattgttgtccgattggaccgacatggtggatggattccaaaaggcggcgctggagtcccgcctgggaataccgcttatttacgggattgatgcagttcatggcaacaataatatatacggcgccacgatattccctcacaacattggccttggagccactagagatgcagagctggttcggaggattggggtcgcaaccgcacttgaagtcagagcaagtggcattccttatacttttgctccatgtgtggctgtgctgaaagatcccagatggggaagatcttatgagagctacagtgaagacactgatatagtcaaaaagatgaccgcaatagtaacgggtttgcaagggcagccaccccaagggcacccaaagggctatcctttcgtagctggaagaaacaatgttattgcttgtgccaagcattttgttggagatggaggaaccgaaagaggtgtaaatgaggggaacactgtaacgtcttatgaagatctagaaaggatacatatggctccctatttggattgtatctcccaaggtgtttgcacagtcatggcatcctactctagctggaatgggcgcaggctgcatactgactattttctcctgacagaggtcttgaaaaataagttaggttttaagggttttgtcatttcagactgggaagggcttgaccgactcagtcaacctcatggctcaaactgccgtcagagtatttctctggcagttaatgccgggattgacatgattatggtgccttttagacatgaacaatttgcagaggatttgatagccttggctgaatcaggggaagtaccaatttccagaatagatgatgcggttcaacggatactgagagtcaagtttgtatctggtctatttgagcatcctttttctgatagatcattgcttcagattgttggttgcaagtcgcatagagaattagcacgtgaagcagttcgaaagtcgttggtattgttgaaaaatgggaaggagcctatgaaaccatttctcccattagacaaaaatgcaaagaaaattctggttgcaggaagtcatgctgatgatctaggttatcaatgtggagggtggactgtcgcttggcatggaagcagtggcaggatcacaatcggtacgactatcttagatgcaatcaaggaagcagttggaggcaacacagaagtgatttacgagcaaaatccatctccttccacattagcaagtcatgattacacatttgctattgttgctgttggtgaaggtccttatgcagaaactctcggtgataaccccgaacttgcaatcccattcaacggaacggacgtgataaagtcagtcgccgagagaatacctacactcgtacttgtcgtctctggaagacccttggtcatagaaccacatgttctggagaagatagatgctcttgttgctgcttggttacctggaagcgaaggaacaggcatcacagatgtggtcttcggcgactatgatttcgaaggtcaattacccatctcgtggtttagaacggttgaacaagtgcctatggaccataaagctaattcctatgatcccttgttccccctgggtttcggattgaaatgcaagaaagaagcccgatgacgaggcaattcaatgagtgatgaagttaatgaccaacagagaagtagctggtccggtcgaaaaatgccttctgaactagatattagtgtgcgtttgcaagaataatcgcttcagatccaatgtcccctaaattcctgttgaaattctagaagctctgaactagatattagagcgcatttgcatgaataatcgcttcaggtccaatgtcccctaaattcctgttgaaattctagaagcgtcagagtggaaaagggaatcgtataatttgtatgctacttttccagaactgcggtttctcactgttgagtgattgtaatattgccatattggcatggataatgataagcagttaaggcagtatggttgcgatagaaaaaaaaaaaa

SEQ ID NO: 171 - DNA, 2052 bp, Eucalyptus grandis
agcagatctctctctcgctgtcggaggtgatccttttccttccttcgcagtctctacagaggacgctccgggaagatgaaaaaaaatggcgagagctcccatctttatggtgggattctagttctctgttgtttctccggcgtgacgagagcggagtacctgaagtacaaagatccgaagcagccgctgaacacccgcatcaacgacctgctgagccgtatgagtctggaggagaagataggccagatgacgcagatcgaacgcagcgtcgcgtccttcgaagtcatgaaaaagtactacatcgggagcgtattgagcggaggagggagcgtcccagctccgcaggcctctgcggagacttggatcgacatggtgaacgatttccagaacggttccttgtctacccggctcggcatccccatgatttatgggattgacgcggtccacggccataacaacgtgtacagggcgacgatatttcctcacaatgtcggtcttggagccaccagggatcctgcgctagtcaagaggatcggagctgcgaccgcactggaagtgagagccacagggattccctatgtttttgcgccctgtattgcggtctgcagggatccgcgatggggtcggtgctacgagagctacagcgaagatcccaagatcgttcaggccatgaccgagattatccccggattgcaaggtgatcttcctgctggttctcggaagggtgtcccctacgtcgccggaaagaaaaatgtggctgcatgctcaaagcattacgttggcgatggcggaacgaccaatggcgtcaatgagaataacactgtaacagattggcacggcttgcttggcatccatatgccgggttactacacttcaatcatcaagggtgtctcaaccgtcatggtttcgtactctagctggaatggagtcaagatgcatgctaatggcaatctagtcacaggcttccttaaaaacaagctccgtttcagagggtttgtcatatcagattgggaaggtattgacaggatcacctctcccccccatgctaactattcctactccattcaagcaggaattagtgcgggcattgacatggtaatggtcccgtcgaatttcacggagttcatcgatgggctaaccttccaggtgaagaataagatcatccccatgagccgaatcgatgatgcggtgaggagaatactgcgagtcaaattcacaatgggcctattcgaggatccactggccgataccagcctagtgaaccagctaggaagtcaggagcatagagaattggctagggaagctgtcagaaggtccttggtgctcctgaagaatggcgaaggagctgatgcgccattacttcctcttcccaagaaagcgccaaaaatacttgttgctggtagccatgcagataacttggggtatcagtgtggtggatggacaattcaatggcagggactaagtggcaacaacctcactagtggtacaacaattctcagtgccattaagaacactgttgatccaaaaaccaaggttgtctatgaggagaacccggacacggacaccgtcaaatctggcaaattctcttatgccattgtagtagtgggagaacacccttatgcagagacatttggcgatagctcaaacttgaccattgccgacccaggtacaagcaccatagggaatgtatgtggagctgtgaagtgtgtggtcgtcatcatctccggtcgtcctgtcgtgatccagccctatgtcgcagtgatggatgctatcgtcgctgcttggcttccaggaactgaaggccaaggggttgcagacgttctgtttggtgattatggcttcacaggcaagcttcctaggacatggttcaagaccgtggatcagcttccattgaatgttggggatcctcattacgatcccctcttcccatttggttttggtctcaccaccgctcctgttaagaggaactaaactaggaattcaatggggacatttacactgtttttgcaccgccaagaatcattgaaatttccatttggcggaaaaaaaaaa

SEQ ID NO: 172 - DNA, 2350 bp, Eucalyptus grandis
agctgttgtggtgttcttgcctatttgctctcagcgcagccggacagagcagtttccctcgaaatgaaactgatggggaggttcccattttgggtgatgtaggactgaaccggggctcttgtgggtcgggtggtgtggactgagagatgggcggggcttttcttcgaacgcttggggtgctcacactatggtggtttgtggcatcggtaatggctcaatccgcagactacgttgcgtacaaggacccaaagcagccggtggccgcaagggtgaaggacctcttgagtagaatgacgctggaagagaagattggtcagatgacacagatcgatcgcatggtggcgactgacgacttcatgaaaacctactcgattgggagtgtcttgagtggtggtgggagcacgccacttccagaggcaagtgcagaggattgggtcaatatgataaatggctatcagaaaggtgctttgtccagtagattgggtatcccaatgatatatggaatagatgctgttcatgggcacaataacgtgtacaatgccacaatttttccgcataatattggtcttggtgcaacaagagaccccaaattggtgaaaaagattggtgctgccacagcccttgaagtcagagccacagggattccttatgtctttgccccctgcattgcagtttgcagagatccaaggtggggcaggtgttatgaaagctatagtgaaaatgaggatattgtgcgacaaatgactgagattatacctggattacaaggagatattccttctggctctcgcaaaggagttccatatgttgatggaaagaacaaggttgcagcgtgtgcaaagcactttgtgggtgatggaggaacttccaaggggatcaatgaggacaacactgttgttgacatgcatggtttgcttagcatccacatgcctgcttatacagatgcaataattaagggtgtttcaacagtcatggtctcttactctagctggaatggagaaaagatgcatgctaatcgtgacctagttactggtttccttaagaacaccctcaaattcaagggctttgttatctcagattggcaaggcatagacaggatcacttctccccctcatgcaaactatacctattctgttgaagctggaattttagctggaatcgacatggttatggttcctttcaattttacagaatttattaatgatctaacttacctagttaaagagaaggttatccctatggatcgaattgatgatgcagtggggagaatattgtttgtcaagttcaccatgggcctctttgaaaatcctctggctgatcttagtctggtgaacgaacttggaagccaggcacacagagagttggcgagggaagctgtgagaaattctcttgtgctgctgaagaatgggaaaaatgagactgatcctttactgccacttccaaagaagccaaagaagatcctggttgcaggtagtcatgctgataatttgggttatcagtgtggtggatggacaatcacctggcaaggatttagtggaaataactacacccgaggaactacaatcctcagtgccataaattctacagttgatttgagcacagaagtagtctaccaagaaaaccctgacaaggattttgtgaagtccactgatttcgattatgctattgttgttgtgggtgagcacccttatgcagagactgccggagatagcacgacacttacaatggcagaccctggtcccaccaccattaccaatgtctgtgaggctatgaagtgtgtggtcatcgtagtttcaggaagacctctcgtaattgaaccatatatatcttcaattgatgccctagtggcagcatggttaccgggcactgaaggtcagggagtggctgatgttctttttggggactatgggttcagtggaaagcttccaaggacgtggttcaaatctgtggatcaactcccaatgaattttggggatttgcactacgatccactctttccttttgattttggactcaaaactgagtctgtcccaggccttgtagcaagagctacctcacacggtgctgatgggggaccacgcctcctaatggtcacagcctgcttagctatcagcttatatgtaacaggttataggtggcgggcgtcgaagttctaattgatatggtagaagatgtaacttctgtagttcatttgtatgttcaccgggcggaaaatgattcatctccttgtatcttctattagtcttatttgattcatgagagcaaaatagcttctccctccccaactttgcagtccgacacagtaatgactcgggtttccagaactatatattggagcacttgatgggat

SEQ ID NO: 173 - DNA, 1740 bp, Eucalyptus grandis
cttctccaaagctcccgctgtgcttctaccgtccgaaacagagcatggcgagtcctgcattctcttgcctcctcctcctcgtgtccatcttcgctctcgcagagtcgggctcggtcggactgaactggggccgcgtagccaacgacctcccgccgccggcgaaagtggtggagctcctgaaatcgcagggcatcaccctggtcaagctctatgacacctacgacggcgccctcacagccctcgctggctccggcataagcgttgtcgtcgccctccccaacgagcagctctcctccgccgcctcggcccagtcgttcaccgactcgtgggtccagtccaacatctccaagtactacccctccaccaagatcgtcgccatcgcggtcggcaacgaggtcttcgtcgaccccaacaacaccactgatttcctcgtgcccgccatgaacaacgtccacgcctccctcgtcaaatacaatctttccgacatttccgtgtcttctccgatcgcgttgagcgcgctccagacttcgtacccgacttcctccgggtcgttcaagtcggatctcgtcgagcccgtgattaagcccatgttggagttccttcgcaagaccgggtcgtacctaatggttaatgtctacccgtttttcgcttacacggccaattcggatcagatctcgctggattacgcgctgttaaagcagaatcctggcgtcgtggattccggtaacggattgaagtacaacagcctcttcgacgcccaagtcgacgccgtctacgctgccatgtctgccctccaatacaacgacctcaagctggtcgtgacggagacgggctggccctccaagggcgatgccaatgaagtcggtgcgggcacccagaatgcggcggcgtataacgggaacctggtgaggcgggccctgaccgggaccgggacgccgttgaggccgaacaacaccgtggatgtgtacttgtttgcacttttcaatgagaaccagaaaacgggtcctacgtcagagcggaactacgggctgttctacccggacgagcagaaggtttacagcataccgctcacgttggagcagctcgcgagcgacccgaacaacgcgagcaaggcccaggtcccgacggcccccgtggggcagacgtggtgcgtggccaacgggaaagccggggaaaagaagctgcaggcggcgctggactacgcctgcggaaagggtggggccgattgccaacccatccaacagggctccgcctgttacaatccgaacacattggaagcccacgcttcgtatgcgttcaatagctactaccagaagaatgcccgtggggcggggacgtgcaatttcggcggcgcagccttcgtggtgacgcaagtccccgaatacggggagtgcgatttccctacggggtactagaaggagagagattcttctaaccaagtcaataaacgacagcgttcggtggagacttggccatgaattgggtggcgggggcttagctcattcctcattctttttctttagacctggcccagtggttgagatgggtatttaatttttgttttgggtctggatagttaggtcctttatctatggctattttatttcttctgcaggaggattaggttcactttcgttcaccagttcccttgactcttccaccgcctgtaattatttagcctccttattgtattttcccccctgttattataatacattggcgattgcttgaaaaaaaaaa

SEQ ID NO: 174 - DNA, 1622 bp, Eucalyptus grandis
actttttaaaaacacttgagcacgcccgcacactccatatccagctcatcgagcaccatccatggcggcttccttcctctccaatccctcctccctctccttcctcctcctcctcctcctcctccacgcttctcgcctcgccttttcgcagtccttcgtcggagtgaactatgggcaggtggccgacaacctcccgccgccggagtccacggcgaagctcctgcagtcgacgacgatcgggaaggtcaggctgtacggcgcggatccggcgataatcaaggcgctggcgaacacgggcatcgggatcgtgatcggcgcggccaacggcgacatcccctcgctggccgccgatcccaacgcggccggccagtgggtcggcgccaacatcctccccttctatcccgccagcaagatcaccctcgtcacggtgggcaatgaggtgttcatgtccaacgacgagaatttgatgtcgcagctcctgccggcgatgcagaacatgcagaaggccatcaccgccgccgggctgggcggcaaggtgaaggtgtcgtcggtgcacgccatgtcgctgctgagccagtccgacccgccgtcgtcgggccggttccacccgtcgttcgaggcccggatgagggacgtgctgcagttccagcgggagaacgggtcgcccctgcccatcaacccgtacccgttcttcgcgtaccagagcgacccgaggcccgagacgctggcgttctgcctgttccagcccaacgccgggcgggtcgactccgggaccgggatcaagtacatgaacatgttcgacgctcaggttgatgctgtttactctgccctaaaggctttgggttacaaggacattgaaatcgtggttgcagagacggggtggccgtacaatggcgacagcaatgaggtcgggcctagcgtagagaatgctaaggcttacaatggcaatttgatcgctcaccttagatctttggttggcactccactgatgcctggcaagtccgtggacacatacatttttgcactctatgacgaggatttgaaaacagggcctacttctgaacgatcgtttggaatgtacaagcctgatctgaccatgagttatgacattggtcttgcgaagagtagccagaccccagtgactccgaccccaaaaccaacaggaccaggctggtgtgttcccaaatccggtgtctccgatgctcaattgcaagcaagtctcgactatgcttgcagccacaacattgattgcggtccgatccaacctggcggtgcttgctttgatccgaacaccgtagcgtcgcatgcagcttttgccatgaacctctactaccaaacatcaggcaggaacccttggaactgcgatttctctcaaacagcaacgctcacgacgaacaatcccagttacaatggctgtgtttaccctggtgggagcacctgaagtgcgatagaactgtatcattagatgatatatataaagcggaataaggaatggcggtgtagttgaagaactttgtccctatatttaggtgtaaagcccttccttcttatatttataggtgtaatacaaatacatatatgtagcacttttccccgtcttttttatttttttaaaaaaaaaa

SEQ ID NO: 175 - DNA, 1711 bp, Eucalyptus grandis
attacttcattattttgttcatctcagattctctttttggagggagagattttgcatttgcatccgcaatggctgtgcccccctttgttcttcttctgcttttagtgggttgtgcttccactgtgaaatctgaccaagagccattcataggagtgaacataggaacggatctttctgacatgccacatccaactcaagttgttgctctcctcaaggcacagaacataaggcacatccgcctgtacaacactgaccgtggcattcttgctgcactagcgaacacgggcattcaagtcattgtctcagtgcctaatgagcaactccttggaattggccaatccaactccacagctgccaactgggtctcccaaaatatcattgttcattacccagccaccaacatcaccggcatttctgtggggtcggaggttctaacggcactccccaatgcagctcccatcctggtaaatgccctaaagttcatccactcggctctagtcgcctcaaaccttgaccgtcagatcaaagtttccactccgctgtcctcgtccgtgatactggactctttcccgccttcccaagcattctttaacaaatccctgaacccagttttggtccccatgctgaattttttgcaatcctcaggatcatatctaatgctcaatgtatacccttactatgactacatgcaatccaatggtgtcattcccttagattatgcactgttcaagcctctgccgtctaacaaagaggcagtggatgcaaacactcttctccactactccaacgtctttgatgctacggtcgacgcagcctacttcgcaatggcttttctgaacttcaccaacattcctgttgtggtgactgaaacgggttggccatcaaagggtgattctaacgagccagacgccacagtggataatgccaacacatataacagtaacttgataaggcatgtgctgaacaagaccgggacacccaagcaccctggcatcacagtcagtacttatatttatgagctttataatgaagatacaaaagcgggtccgctatctgagaagaactggggattgtttgatgctagtgggagccccatttacatattgcacttgacagggtcgggatcagttctggcgaatgacacgacaaaccaaacatattgtactgcaaaggaaggtgcagacccaaagatgctgcaggctgctttggattgggcctgtggagtcggcaaggtggattgctcacccatgttgcagggcgaatcatgctatgaaccggacacattatctgcacatgccacctacgcatttgatacatactatcatcaaatggggaaggctcctggaacttgtgatttcaacggggtggctgcaatcaccaccacagatccaagtcatggtacttgcatattttcaggaagtcttggtagaaacgcgacatcggtgaatgtgacggccccatctatgaattcaacaacctcgggatcacctgccttaaattattacaaccagcacgtcttgcttcttgttgtggatgaaagttctggtcttgagtgccttgttcttgtagaatggtacatatctaggtgaagaaacgcagtctgtttctgaagattatattgtgattagaccggatggttttagggaatagggaaagtgatctggtcaaattttgtgcaaatcaagcgggaagcctccctttaaaaaaaaaa

SEQ ID NO: 176 - DNA, 2155 bp, Eucalyptus grandis
ccacattccaccccttatagttttttgggctgtgctgttttctgattctttcaagatttttcccccttttttccctcaggaaaattcagagagacccatctgaagaatctccaaagaaaatggcagaatcaatatctcattatccctttccgacccttggactaatagttctctgcttcatgaccatgttctcaattgggtcaagcgttggagtgaactgggggacgcagtcaaaccaccagctcccgcctgagaaagttgtgaaaatgctgaaagaaaatggcatcaagaagctgaaactgttcgaatatgatgagaagattctgggggctctcgctgggagcaaaatcgaagtgatgcttgccgttcctaattacatgctggagattatgagcgtggatccaagttttgctgcctcttgggtggacacgaatgtcaccagttaccgatacaccggtggagttaatatcaagttcagtgatcatgttctttggtttatgaagatgtttgcattatctcatctgcagaaaattttttgaagcttcattttgatttggattctatctactcaaaaacttcttgtcttgccgatatctactcggagaagttgagtacatacggagtcatatcctgtcacatttatgaattgcttctctttcattatgctttaggtaagatgttgttaggcaattgtagtgttgcagtcatcaatcatttcacaaccaattgatcacaaattcataactggtagttactcccatgcagttggcattctctttcaaatggtcacgcactttccatccttcaggctcgctttctttgtttttggttgtgtcaaaagagacatgtcatgcacatttcattgcagtgaaattaggcccataaggttttgattcttgcaggtacattgctgtaggaaatgagcccttcttgcaaagctacaatcacaagtatgtccgacaagtattgccagccctccggaacattcacgaggccctccaccgtgcccggctaagctccaaggtcaaagttacggtcccgttcaacgccgacgtctactattcgccgcccccaaacgagtacccttcttccggtgacttcaggcctgaagttcgtgatgcagcgatagaaattattcacttcctatacataaatgattcgcctttcaccgtcaacatctaccccttcctcagcctctaccaaaaccaaaatttccctgttgactttgccttcttcgacggaacgactgagcccgtcaaagatggggatcgggtgtatacaaatgtgtttgacgcgaacttcgacatactcgtctcggccttgactaaagcagggtactctgacatggagatcttagttggagaaattgggtggccgactgatggcgacaagtttgcaaacatcaaaaatgcccagaggttcaatcagggcctgctgaagcatgccttgagtggagacggcacgccggcaaggaaaggagtgatcgacgtgtacctcttcagcctaatcgacgaggacacaaagaacatagatccggggaacttcgagcggcactggggattgttcgagtatgatgggaagccaaagtatgaactggacttgtcaggatcggagaaggacacccgccttgtcccagtcatgggcgtgtcctacatgccgcggaggtggtgcattttgaaccccgaattgaatgatctaacagacctaggagagaacatagactacgcttgcaaatcttccgactgcactgctctgggttatgggtcgtcctgtaacaacctgagctcgcagggcaatgcttcctatgcattcaacaggtactatcagatgaatgaccaacgtatcatggcctgcgatttccagggtcttgccgaggtcactgagaatgacccgtccacggaagaatgccaattcccgttgatgttagcgtccggagactcgatgtcctggaaccagggatcgctacatacttcgttcagattctatttgtggtttctggttttctgggtaattttatagtccttctgctaggaggttgtcaggttttgctactacaaatgctagagggaataacatcagctttttgtattggcatagtcagaaatctaagtatttttgccaaggaatgataatatccttcgagtcaaaaaaaaaa

SEQ ID NO: 177 - DNA, 1287 bp, Eucalyptus grandis
ccgtttcttccttgcctttcttcctatctcttcacatggctaaaatcatctccatggcgagcggttgctcgtcggctcctgccgtttgtcttctgggacttctgatagccagtttctgcacggcaggtgtgcaatccataggagtttgctatgggatgctcgggaacaacctgccgtccgcgtcggaagtcgtcgccctctacaagtcccgcggcatcacgcagatgagactctacgaccctagccaaccagctctacaagccctgagaggctcgaacatcgagctcatccttggcgtccccaactcggagctccaggcccttgcttccaaccccgccaacgcgaactcgtgggtgcagaggaacgtgaagaactactcgcctggtgtcaggttccgctacatcgccgttggcaacgaggtgagccctgtcaacggaggcactgcacaattcgccaggtttgtcctccctgcgatgaggaacatacaggccgcgctcagatcgtccggcctgcagaaccagatcaaggtctcgactgccatcgacatgaccctgatcgggaactcctaccctccatcccaaggtgcattccgcggggacgtgaggtcctacctggacccgatcatcagtttcctggtgaacaacaactctccattgctagccaacatctacacctacttcagctacgtcggcaacccgaaagacatcagcctgccctacgctctattcacctcgccatcggtcgtcgtccgagacggagcccatgagtaccggaacctgttcgacgcgatgctggacgccctctactccgccctcgagagggctggcggggcttccctccgggtggtggtctcggagagcggctggccatccgcgggcgcgttcgctgccacggtcgacaacgcgaggacatacaacgggaatctgatcaagcacgtgaagggcggcacgccgaagaggccaaacggggcgatcgagacctacatattcgccttgttcgacgagaaccagaagcagccggagctggagaagcacttcgggctcttcttccccaacaagcagcccaagtacccgctcagctttgcgcagggaaggatttgggatgtctatgacaatgtcacaggtcctctcaaaagtgacatgtgagtagtaggtgtggagcttttgcatctcccagaagatctgaaataaagaggatccctctggtttgcgttgtaatcttcaagagctgtgaaatttgttcctcatgcttggtgaaataaaagtatatgttgctttaaaaaaaaaa

SEQ ID NO: 178 - DNA, 1754 bp, Eucalyptus grandis
gtccaactcaggtttctgcgtcgttggtagttggattctatctctaactcagtggaaagttcggtttaaattataggaggacccaagtaaattgattatttaggtggatcgaactgaaattttgtgagtatggggttctttaaatttatagcttttagtaggctgtgtgttgccctgttattcttggctgagctggtgacctcggtgggtggaatcggagtaaactggggaacgcagacgacacatcctttgccgcctgcgacggtggtaaggatgctgaaggacaacgggtttcagaaggtgaagtttttcgatgccaattcgagctacttgagtgctctgagtaagtctgggcttcaggtgatgttggggattccgaatgacatgctctcttctctggcgagcaacgttgaggcggcggagaattgggtcgcgcagaatctctctacttatgtctcctccaatggagtggacatccggcatattgcagtagggaatgaaccgtttctctcgacgtacaacggaacctaccttaatacaacccttcccgccctccagaatgtccaggcagctgttgtgaaagccggattgagcacacaggtcaaagtcaccatccctctcaatgctgatgtgttagagagctcgacgaaccttccttctgatggagacttccggtcagatatccgtgatctcatgttggagatcgtcaagttcctcagcgacaatggagctcctttcaccatcaacatctaccctttcattagcctctacaacgaccccaacttcccagcggaatttgccttcttcgacagctcgtcatcgccgctgaacgataaaggtactatatacaccaatgtgttggatgcaaatcacgacatgcttgtgtgggccctgcagaagaatggttatggaaacatgtccatcactgttggagagatcggttggcctacagatggagacaagaatgcaaatgcgaagagcgctcaacggttcaaccaagggtttatgactcagtattcggctggaaaggggacccccttgaggcctggccaaatggacgcctacttgttcagcctaatcgatgaagatgcaaagagcattcaaccaggcaacttcgagcgccattggggcttgttctctttcgacgggcagccaaagtaccagctcaatctcggttccacaagctcaaatggcttggtggctgcaagggatgtcaaatatctggctaagaaatggtgcgtgatgtcacagtcagcgagcctccaagactcgcaagtggcgcctagcgtgagctacgcctgcgccaacgcggactgcacgagtcttgggtacgggaattcgtgtagcaacttgactgctcaagggaacatctcgtacgcgttcaatagctactaccagcagcatgaccaactcgacaccgcctgtcaattccctaacctatcggtgattacggacaacgatccatctgttggagattgtaaattcattatcatgatccaatcgcagtccatgagcttggttgggagtgacggatctcggggaagaggtatagttccagccatattggtgtcttcattgctgtacatgattttatggatgccatagttatttcatatgaagtacatgattgtagtaaggcattgtggcttcgttataggtgctgtctgacacttcgtacacagttatacttgtctccattctcttgtaaatagacattatcaagacatggaaagtagttgaattcaaaaaaaaaa

SEQ ID NO: 179 - DNA, 1892 bp, Eucalyptus grandis
gtggattgaggcgctcgctctggtcttggtgaatccatggctctgctgcttctcttcttgcttctgtttccggtctcccttgcttccgcggatgaaggtcccttcattggtgtgaacataggcactgacctctccaacatgccgagcccaactcaggtggtggcgcttctaaaagctcagaacatacgacatgttaggctttatgacactgatcacgccatgctccttgcacttgctaactctggcatccgcgtcactgtttctgttcctaatgaccagctacttggcatcgggcagtccaatgccaccgctgcctattgggtagctcgcaatattgtagcccatgtccctgccaccaacatcacggtcattgctgtgggatccgaagtcctaacgacccttcagaatgccgcccctgtccttgtgtcagccatgaagttcatccactcagcgcttgtcgcttcgaatcttgacagtcgtatcaaagtctcaaccccccactcttcctccatcattattgactccttcccaccttctcaagccttctttaaccgcacttgggatccggtcatggtcccattgcttaagtttcttcagtctactgggtcgtacctcatgctcaatgtctatccatactacgactacatgcagtctaatggcgcaattccactggactatgccctcttccgtcctcttcctccgaacaaggaagctgtcgattctaacacgctccttcactacaacaatgtatttgatgccgtcgttgatgcggcttattttgccatgtcatatctaaacttcaccaacgtccccattgtggtgactgagtctggttggccctccaagggagactcctccgaagcggatgcaactcttgaaaatgcaaacacttacaacagtaacttgatcaagcacgtgcttaacaatacaggaacgccaaagcacccgggcgtggcagtcagtacatacatttatgagctctacaatgaggatcagagaccaggctctgtatctgagaaaaattggggcctgtttgatgccaatggagtgccgatctatatcttgcacttgacgggtgcgggaacggtgttagcaaatgacacaaccaatcagacgttctgtgttggaaaggatggtgcggacaagaagatgctccaagcggcattggattgggcttgtggacctgggaaagtagactgctcactgttgttgcaggggcaagcttgctatgaaccagacaacgttgttgcacatgcaacttatgctttcaatgcgtattaccaaaagatggggaaagctctaggcacctgtgattttaaaggggtcgctacagtcaccacaaccaatccaagtcatggttcatgtatatttccaggaagcggtggaagaaatgggacttccgttaatggtactattctggctccatcgtctaattcaacgacttctggctgtcctccccagtatttcttcgatgttggttcgatcacaagctcgttgatcatcaccattttgcacctggcgttggttctcttgtaaagttatggactcgatatttgtgtcatattgattgatgcctttttagatctctctttgaaacatttaattacaattcttcgatgacaacttgtggtctacccaattttgtggttcgtgaagtggcaacacgggtgggcaaatccaggcatttgagcggcgactagctaggtgactcttcaaatttattctgtaaaagccaacaaaaggagttgttggtgtaactatcttcttcctaaattcgattttgaattgattctttgagatggacacttaaagggcgtctgaaagtcagccaattctggccatgtaatcaataggctaggattagttgcctcgttttctcatcaaaaaaaaaa

SEQ ID NO: 180 - DNA, 1816 bp, Eucalyptus grandis
ccccccccccacaatccctttccctctctctctctctctctctgctgtactctcctttcgacgaagctgcgggaggcgtactggcaaattttggggagtgagtgagtgacgcgacgagaatcgaccggcgcgggtcgattcccgcattcattcatccgtcccggttcctctcctctccatttcgcgattccaggctcgctcgagatccggatctagtttggtccgtcctccccccaccccgaggatgggaagcgccgaggagagagtggtcgccgtcatcatggtcggcggccccaccaaaggtactcgatttcggccgctgtcgctgaatattccgaagccgcttttccctttagcggggcagcccatggttcaccatccaatctctgcttgtaaaagaattccaaatctagctcagatctatctcgtgggtttctatgaggagcgtgaatttgcgctgtacgtgtcctcgatttcgaacgaacttaaggtccccgtcagatatctaaaggaagacaagccacatggttctgctggtggtctgtataacttcagagatctgataatggaagacagcccgtctcatatcttcttgctgaactgcgatgtttgctgcagtttcccattgccagaaatgcttgaggctcatataagttacggtgcgatgggaacccttctcgtgattaaggtctctgcagaatcagcaagccagtttggtgaacttatagctgatccaagtaccaaagagttgttgcattacacagagaaaccagagacatttgtgagtgacctgataaattgtggtgtttacatatttacaccagaaatattcagtgccatccgcaatgtgtccactcaacggaaagacagagccaatttgaaacgtgtctccagctttgaggccttacaaccagcgacaagaaatctccccacagatttcatgcgattggatcaagatatcttatcacctctagctggaaaaaggcagctatatacatatgaaaccatggacttctgggaacaaataaagactccaggaatgtccttaaaatgttcaggtttgtatcttgcacagtttcgctctacctctccccatcttttggcaagtggagatggtacaaagggtgctaccattattggtgatgtctatattcatccatcggcgaaagtgcacccaactgccaagattggacctaatgtctccatatcagctaacgcacgtgtaggagcaggtgccaggctcatgaattgtatcatcctcgatgatgtcgagatcaaggaaaatgcagtggttactcattcaattattgggtggaaatcttccattgggaaatggtcacgtgcccagggtggaggagactacaatgcgaagcttggaataacaatcctcggtgaagctgtgaccgttgaagatgaggtggtggtaatcaacagcatcgtccttcccaacaagactatgaatatcagtgttcaggaggagataattttatgatacagctactcggcaaaacaataataatggtgatactggcggatagcacctgatggatggttcaaatgattgatgaattcgacactgggtgctggaataagggtttaagctgagattaacgacccgaagatagaagtctgccattctcattgttgtgcttgtatgttttactattgaactgtaaaaagctctcagattactagcttatcgtgggctgtatatggtgtatttgaaactagagcagaatgtgactatgcatatttcctggttattcagacatggtaatgagaaagaccgtgagggatcttttcttgaaaaaaaaaa

SEQ ID NO: 181 - DNA, 1711 bp, Eucalyptus grandis
ccgcacctttcgttttcttctgttttccactaaaaaggttttgagtagagattccgccaaaatgccaaaaaggattccctctcctcttcaaacaccagcctcctagtttggtccggccactttgccagcaacggaagctagggaatcgaacttgctgaattcgatcgaagtgcgaatccgatcttcaccgggaatctgaagttttgagctctgcggtcaactgggtttagggttctttggagatggagaactcgggggagatggagaaggtggtcgccgtgatcatggttggtggacccaccaaaggcactagatttaggcctctctcgttcaacacgccgaagccgctcttccctttggccgggcaacccatggttcaccatcccatctctgcttgcaaaaggatccccaacttagctcaaattttcctgattgggttttacgacgagaaggagtttgccttatacgtctcttccatatcgaatgagctgagagtcccagtgagatacttgaaagaggataaaccgcatggttcagctggtggcctctatcatttcaggaatttgattatggaagacagcccgtctcatatttttctactgaactgtgatgtctgctgcaattttccacttccagatatgcttgaagcccataaaagatatggtgggatgggaacaatgctagtagtcaaggtttctgctgaatcagctaaccagtttgatgttttttctgcaattgaggatgtatctaatgaccgggaagacagagctaatctgcggagattatccagcattgatataagcacatctacaagaaccaacattcctacagattttgttagattggaccaggatatattgtcacctctctctggaaagaagcagctttatacatatgagaccatggattattgggaacagatcaagacaccagggatatctttgaaatgctccggtttgtatctggcccagttcagactcacctctccccatcttcttgctagtggagatggtacaagaagtgccacggttgtcggtgatgttttcgttcacccatcagctaaagtccatccaactgcgaagattggccccaacgtctctatttcagcaaatgttcgtgtaggacctggtgtgaggctgataagctgtatcattttggatgatgttgaattagaggataatgcaatagttataaattccattgttggatggaaatcatctcttgggagatggtcaagagtccaggctgatggagactacaactcaaagttgggaatcacaattcttggggaatctgtggtggtagaacaagaagtcgtcgtcgtcaacagcatcgttctgccaaataagatcctcaacgtgagtgtgcaggatgagatcatcttgtgaagagttggagatgtttgaatttcaaagccctccaaggtgcactatttggaagagtttgttttgttccatatagagacggtaatacgagagagagatatgaattgtcccatagaattaggtaaataagaattaaaggggtttcatgtgaaaacttgattagcatcgtaaaatacgagtcatcattcgtactttgtttcacttgtttttcaagtttctgcttaatagcaagacaagcaacgcaattgtgccaattgtcgcttatgttttctccggattagcttttgatcacggagttctacaaatccattgtaaagaattgataa

SEQ ID NO: 182 - DNA, 1487 bp, Eucalyptus grandis
ctgctaattcttgaagaccgtactccgatccagctgctggggaacctagggacaacatcatcatcatcatcatgaaggctttaattcttgttggtggatttgggactcggctgaggcctctcacgcttagtgtccccaagccacttgttgactttgctaacaaaccaatgatcctgcatcagatagaggcactcaaggccattggagtgagtgaagtggttttggctatcaattaccaaccagagattatgctgaacttcttgaaaggctttgaggccaagcttgggattaagatcacatgctcacaagagactgagcctctcggaactgctggtcctcttgctctggcaagggacaagctgctagatgattctggtgagccgttttttgttctcaacagcgatgtgataagcgagtacccactcaaagaaatgattcaattccacaaagcccatggaggagaggcctctataatggtaacaaaggtggatgagccatcaaagtatggcgtggtgatcatggaagagtcaactggtcaagttgagaaatttgtggaaaagccaaaaatctttgttggcaacaaaattaacgctgggatatacttgctgaacccatcggtccttgatcggatccagctgaggcctacttccattgagaaggaagttttccccaagattgcggccgagaagcagctcttcgcaatggtcttacctgggttctggatggacattggacagccgagggattacatcacagggctgagactctatcttgactcgatcagaaagaagtcatcagagaaattggcaactggacctcacattgtcggcaacgtcttggtagacgagaccgctaagattggtgaggggtgtctaattggtcctgatgtggcaattggtccaggctgtgtggttgaatcgggagttagattatctcgctgcacagtcatgcgcggagtccgcatcaagaagcatgcttgcatttctagcagcatcataggatggcactcgacagttgggcagtgggctcgggtggaaaatatgactatattgggggaagatgtccatgttggagatgaaatctatagcaatggaggcgtcgtcctaccgcacaaggagatcaagtctagcattttgaaaccagagatcgtcatgtgacagtaagattttcaggcaagtaaagtagagcatatgcttagggtctgtattctatccaagttcagacatggaaaaagaacaggaataaaaaagaaaggaaggtgttttgttcttttctttgtcggttcattttttttttttttccattttccctttctcttgcccaagtgtgttggtcgcttgcttcaacttgggaatggagtgatattggaagttcatgtatgttggagagtcagtgtcttgtgaagtgtaagagcataaattatgattggtgtgagctttgtaatctctagaacatgtatagaaataaaagtttaatcaaaaaaaaaa

SEQ ID NO: 183 - DNA, 1752 bp, Eucalyptus grandis
ctctctctctcttgctctctctcttttgctctcgctctgccccgccatcttttctgccgtgaccaatggagacgcggtcgtccccgaaactgaggaggctccggtgctccgtccagaagtacgattggggccgccgcggggcggaatcgcgggtcgccaagctgttcgcgctcaattccggcgccgaggcagaccccgacaggccgtacgcggagttctggatggggacccacggctccgggccgtccttcctgttgccagccgggtgcggcaatgggggccacaaagtctccccggacgtcactctgaaggcctggatttcgagcaacccggatgttcttggtgataaggtggtggccgagtggggctgcgatctccccttcttgttcaaggtgctttcgatcgcaaaaccattgtcgatacaggctcacccagataaggaattggcgagggctttgcacaaggcgcggccagatgtttacaaggatgctaatcacaagcccgagatggctttggccttaaccaagttcgaggccatctgtggattcattagcatggaggaacttaaacaagtgctgtgtgatgttccagagattgcggaattagttggcagtacagatgtggaaaaattcatcaaactgggtgaacaagaagtggagaaagcgaagtgtcttctgcagtcgatttttaccaaactcatgtcagctagtgcagatatagttgctttggcagtttcccagataaatagtcgtttggagttggagagtcaggtgagaccattgacagataaggaacagctggtgctgcggctagaaaagcaatatccagctgatgtgggggtaatttcagcattctttctcaactatgtgaggcttaatccaggcgaggcattgtatctgggggcaaatgaaccccatgcatacgtatctggtgagtgtattgagtgcatggcaacatctgacaatgttgtgcgagctggcctcactcctaagaccaaggatatccagactctttgttccatgctcacttacaagcagggctttccggacatcctaaaaggagtacctctgaaaacgtacataacgagatacattcccccgtttgatgaatttgaggttgaccgctgtgtactacccaagggctcatcggccgtcttttctgcagttctgggtccttccatttttcttgtgaccgacggcgagggaactataaatgtggggtccgtgaagcaagatgtagttgctgaaggctatgttttatttgtacctgcgaacgtggaaattcatgtgacatctgtgacagagctgcatgtgtatagagcaggagttaatgacaggtttctcaagtcccgtgagttggaaaacggcaagaagtctcagatttaaatccagtgtaggacacaaaagattttgttatgccttctgtggtcagtctccgttgtgtatgtaaatcattcgttttcattagtttcttgcatgtacatgcatgaaacatgagatcaagcgagtcttatggggaattataacataattcttcataaagtagttgtagactctgatctcaggcaaagataagctcttgctgcaacctcctgaggttaaaattcttgagcaaaatccagtaattcctatcccgtaccttccatggttccctttagtcaaggaagtgtcctttgttttgaagtttgaatccagccgcaatatttacaaggatcgatctatttcacatttttgcggggatgagatatttgat

SEQ ID NO: 184 - DNA, 3755 bp, Eucalyptus grandis
cttccctttctctctctagaatccttatctcctgcgacgggaggctcttctctctctagccagcgcccctgcctgcggcggcgatggcggggaacgactggatcaacagctacctcgaggcgatcctcgacgtcggcccggcgctcgacgacaagaaatcgtcgctgctgctgcgggagcgcggccgcttcagccccacccgctacttcgtcgaggaggtcatcaccggcttcgatgagaccgatctctaccgctcctgggtcaaggcccaggcgacgaggagcccgcaggagaggaacacgcgactggagaacatgtgctggaggatttggaacctcgcgcggcagaagaagcagcttgaaggtgaagaagcccagagaaaatctaagcgtcgacttgaacgtgaaaggggtcgcagagaagcgactgcggacatgtctgaggacttatctgagggagaaaagggtgatgcagtcagcgatatatcgactcatggtgatagcaacagaggcagattgcctaggataagttctgttgatgcaatggagacatgggttggtcaacagaaggggaagaagctttaccttgtattaataagtcttcatggccttatacggggtgaaaacatggagcttggccgtgactcggatactggtggtcaggtcaagtatgtcgttgaacttgcaagggcattaggttcaatgccaggcgtttatcgagtggacttgcttactagacagatatcgtcaccagatgttgattggagttatggcgaacccacggagatgttgtctccaagaaattctgaaggtttatcggacgaaatgggagagagcagtggtgcttatatcgtccgtataccttttggaccaagagataagtatgttccgaaggaacttttatggccccacatccgtgaatttgttgacggtgcactcagccatgtaatacaaatgtcaaaagtcctaggagagcaagttggcggtggccaaccagtgtggcctgttgccatccatggtcactatgctgatgctggggattccgctgctcttctatctggggctcttaacgtaccaatgctatttactggtcactcacttggtcgagataagttggaacaactcctcaagcaaggccgtctgtccagggatgaaatcaatacgacatacaagataatgcgccgaatagaggcagaagaactgtcccttgattcctctgagatagtgataactagtactaggcaggagattgatgagcaatggcgcttgtatgatgcttttgatccgatattggagaagaagctacgagcaaggataaagcgcaatgtaagctgttatggaaggttcatgccgcgcatggctataatacctccgggaatggaatttcacaatattgctccacaagatggtgatatggatggggagatggaaggaaatgatgatcatcctactacccaagatccacctatttggactgagataatgcgatttttcaataaccctcggaagcccatgattttagcacttgcaaggccagaccccaagaagaacatcacgacactggtcaaagcatttggagaatgccgaccattacaagaactggctaatctgactctcattatgggtaatcgagatggcattgatgaaatgtcaagcacaagttcttctgttctcctgtctgtgctgaagcttattgacaaatatgatctttatgggcaagtggcatatcctaaacaccacaaacagtctgatgttcccgatatatatcggctagctgcaaaaacaaagggtgttttcatcaatccagctttcattgaaccatttgggcttaccttaatagaggcagcagctcatggtttgccgatggttgccacaaaaaatggaggtcctgttgatatacacagggttcttgacaatggccttcttattgatccccatgatcagcggtcgattgctgacgctcttctgaagttggtggcagataaacatctctgggctaggtgccggcagaatggactgaagaatattcacctattttcatggccagagcattgcaagacttatctctctcggatagcaagttgcaagcccaggcatccacagtggcaaagaagtgaggatggtcttggaaattcagaatctgattcgccaagtgattctttgagggatatccaggatctgtccctaaatttgaagttctcattggacggggagaagaatgacgctagtggaaatgagaattctgtaggatctgaagagaattcagcagatagaaaaaataagttagagaatgctgtaatgacatggtccaaaggtgttttaaaggataagaagacgggattagtggagaaatctgatccgaatgccaattcttccaaatttccacccctgaggaggagaaagcacatctttgtccttgctgtggactgtgattcgctgacagatcttcttgaaatcatacaaaaggttttctcttctgtggagaatgagaggaatgaaggctccatcggatttatactgtcaacgtctttgacgatgtctgaggttcacagttttctagtttctgggggtttgagtcctaatgatttcgatgcatttatctgcaacagtggtagtgatctctactatccatctctcaattctgagaaccgtccatttgtgatcgacttctactaccattcacacattgaatatcgatggggtggcgaagggttaaggaagactttggttcgttgggcaactaatattaatgacaagagggctgaaaatgaagcccagattgtcactctggcagagaagctctccactgactactgctacaccttcaaagtggaaaagctgggaatggttcccccggttaaggaagtgcggaagatgatgagaattcaggctttacgttcgcatgctgtttattgccaaaattggaccaggctgaatgtcattccagttctggcatctcgtgcccaagcacttaggtacttgtatgtgcgatggggagtcgacctatcaaagatggtggtttttgttggagaatgtggtgacacagattacgaaggattgctcggagggttgcacaagagtgttatacttaagggtgtttgtggcagcgccagcaatcaattccatgccaacagaaactatcctctttcagatgtaatgccctttgacagcgcaaacatcgttcagacacctcaagactgcagcagcgatgacattcgggcttctctggagaatttaggagtcttgaaagagtgaaagattcttctccatgacctgttctaaactttatcacaggaggtactcgtcgtcatccctcacagcttgacattcattcctttgctcttctttcaagatgcattcccacatagctgttctcttactcgatgatgaagcctcctactgctggaatccgagctgtttttgtttcgttgtttgcgtcgaaaagtccatcgtctacttttcctttcattcatttccttcggtcacaggatcttgagaaggtgagtatctcgctgttacttgtatattagtgccggtgcatcttctgatgctcttcttttggacgttaaaactggtggatattgccatctcccaagctgttccaatgtatctaaggaggaacctgatgtatatacataagtggccctctcccctcctccccctctctcgcacgcgtgcatgcccacgtgcaactcaaagcttgaccaaacagtggcatataaatatctacatgtactctctcgttcaaaaaaaaaa

SEQ ID NO: 185 - DNA, 3619 bp, Eucalyptus grandis
agattcatcaactctctctctctctctctctctctctgtgtaaagacctcgtccccgaagatattgcagggaaatcttttagccttggaaaaatctcttcattctttccttcttcttttttatctaattttggtggggggagctatctgggttttgtctcattacctctcacgcagtcttattttcgtggagtaaaacaaaagagagctctcttctcgctgcctttcttgtgtcccttttggggtcacgagattcaaggggaaaattgagaggaagaagaagcggagacggagaccgataggagaggagggataatggcggggaacgagtggatcaatggctacttggaggcgattctggatgccggacggtacaacgtgaagagaagaggcgacgggaagattggcggtggcggtaagggtggtgttgttgctactgagtttgatggtaatgagagggagggaagcttgtttagccccaccaggtactttgtggaagaagttgtcaatagctttgatgagtctgatcttcacaagacatggatcaaggtgatagcaacaaggaatactcgtgagcgcaataacaggctcgagaatatgtgctggcggatttggcatctcgcccgcaaaaagaagcagatagcatgggatgatgcgcaaaggctagcgaaacggcgcctcgagcgcgagcaaggccgtagcgaagcggcagatgatctctctgagctttcagaaggagagaaggagaaaggcgacggcagccacagtcccgagcccgcaaaagacaagattgccaggatcaactccgacttgcaagcatggtcagacgatgaaaagccgcggcaactctacattgtcttgataagtatgcacgggctggtgcgtggagaaaatatggaactcggccgggactccgacactggcggtcaggtgaagtatgtcgttgaacttgctcgagctctggcgagcaccaaaggagtgtaccgtgtcgatctgttgacccggcaaatcacctcacacgaggtggactcgagctatggtgagcccatcgaaatgctgtcttgtcccgctgatgctggtgacggctgcggtgcctatattattcgcatgccttgcgggcctagtaacgagtacattccaaaggagtcactttggcctcatgtacccgaatttgtcgatggagcactgaaccacattgtcaacatggcgagagtcctcggtgaacagattgatggtaagccggtttggccttacgtgatacatggccattatgccgatgcagcggaggcggcagcactcctgtccggtgtcctgaacgtgccgatggtcctaacggggcactcactcgggaggaacaagtttgagcaattgctcaaacaaggaaggctttctagggaggacattaacacgacctacaaaattatgagaaggattgaggcggaggagctgggtttggatgccgccgagatggtggttacgagcacaaggcaagagatcgaagagcaatggggcttgtacgacgggttcgatctcaagttggagaggaagcttcgggttaggcgacggcgtggggtgagttgctacggacggtacatgccgaggatggtggtcatacctccgggaatggacttcagcaatgtgaaagtagaagattcaactgaaagcgagagcgacctcaaatccttgattagttcagacaagactcctaacaagagacatttaccgcgcatatggtctgaggtgatgagatttttctcgaatcctcataagccgatgatactggcattgtcccgtcctgaccccaagaaaaatgtcacaaccttgctgaaggctttcggggagtgccaacaccttcgagaactagccaacctgacattaattcttggcaacagagatgacattgaggagatgccggaaggtagctccgtcgtgctcacgaatgtactcaagctcatcgacaagtataatttgtatggtcaggtggcgtacccaaagcaccacaagcaaagtgatgtccctgaaatttataggctggctgctaaaacaaagggagttttcatcaatccagcactcgtggagccatttggtctcacgctaattgaggcagctgcgtatggattgccaatcgtagccaccaggaatggagggcctgtagacatcttgaaggcactaaacaacggcctcctcattgaccctcatgatcagaaagccatagcagatgctcttctgaagctcgtggcggacaaaagcctatgggcagaatgccggaaaaatggattaaagaacatacattgtttctcatggactgagcattgtcataactatctctcccaagttgatcactgccggaatcgccatcccacttcccgtttccagattatgccgatcccagaagaaccattgagtgagtcactcagagacgtcgaggacctatctttgaagttttctatagatggcgaactcaaggcaaatggagagcttgatcttgcaacccgacagaaggaactcattgaagctctcacaagaaaagttcacccaaatggcggttctccttccattagtctatcaagtagaagacagaaaatatttgcgatagccctcgacccctatgacagcggtggcctgttcaccaatatctttagagtgacaatcaagaatattatgaaggtcgcacgagggtactcaggtttgaacagagtgggtttcgtgcttctcaccggtgcaaccttacaagagacattgaatgcttttaaaggcagtgatataaatgtagaagaattcgaggcgttatcctgcaacagtggaagctcaatatactatccagggagagatttcatagccgatgtggactacgagggccatttggagtacaggtggcctggagacaatgttcgctcaatggtcttgaggcttgccaaggcggaggatggcatggaggatgatattgaagagcttaaagccggatgcaactcgagatgctttgctttcagcattaaaccaggaggaaaggttcgaaggattgatgaccttaggcaagcgctcagaatgcgaggttttcgttgccacatcgtctattcatgtgcaggaacgaggttgagcgtgatgcctctgtttgcatcaagaattcaagcactgaggtatctttcaatcaggtggggaatcgattttgcggactcggtcgtgtttgtgggagataaaggagacacggactatgagcaactgttaggcggccttcacaaaactatcatactgaatggtacagtggaatgtggcagcgagaaacttcttcgaagtgaagagaacttcaagagggtcgatgtcgtcgctctcaatagccccaggattcggattgtagaagacggctctgaagaggacatttcgagggctttggaaagcttgcggatgaagtaatccaaagtgccattggggttcttcagttaatcttcagaaactctgaaatgcctaagtgaatatggcataccggttacaatgaaaaagaaaagcaaggatatgtaattatgtgacctgacaaacagcatgtctcgtcatctacttgtctaaaattcctacagcatgtactgtcaaattattcagtaaaattctctcccgtaaaaaaaaaa

SEQ ID NO: 186 - DNA, 3458 bp, Eucalyptus grandis
cctgtctctctctgtttctctctgtttttctctgtctctctgtctctgtgtctctgtgtgcgggtgggaaatggcggggaacgagtgggtgaacagctacctggaggccatcctcgacgtcggcccggcgctcgacgaccccaagtcgtcgtcgctgctgctgagggagaggggccgcttcagccccacccgctacttcgtcgagcaggtcatcaccggcttcgacgagaccgatctccaccgctcctggctccgggccgcggcgacccggagcccgcaggagaggaacaccaggttggagaacatgtgctggaggatatggaatctcgctcgcaagaagaagcagcttgagggagaggaagctcaacgcatcgctaagcggcgtcttgaacatgaaagaggtcgtagagaggcaacagccgacatgtccgaagatttatcatcagaaggcgaaaaaggggattcggcaactgatatctcgtctcaaggtggagagaggatgcctagaaccggctctgttgatatcatggacaaatgggctagcagacagaaggactgcaagctttaccttgtcctaataagccttcatggcttggtacgtggagaaaacctggagcttggccgtgattctgataccggtgggcaggttaaatatgtggtggagcttgcgagggcactaggcacaataccaggagtttatcgggtcgatctgctgacaaggcaaatatcagctccggatgtcgactggagttatggggaaccgacagagatgctgaggacaagaaactctgaatttccacttcaggaaattggcgaaagcagtgggtcatatatcatccgaataccttgcggccctagaaacaaatatgtacaaaaagaacttctctggcctcacattcctgaatttgttgatggtgcactgagtcatatcacacagatgtccaaagtgctgggtgaacaaattggtggtggccgaccagtttggcctgcggctattcatgggcattacgcagatgcaggtgatgctgctgctcttctttctggagctctaaatgtacccatgctttttaccggtcactcgcttgggcgtgacaagctcgaacagctattgaagcaaggaagactggcagaggaaataaatacagcatataaaataaggcgccggattgaagccgaggagctttctcttgacacttcagaaatcatcattactagcacaaggcaggaaatagaacagcagtggcgcttgtatgatggctttgatccagtattagagcgaaaactaagagcaaggattaaaaggggtgtcagctgtcatggaagatatatgccgcgctttgtggtaattcctcctggaatggaatttcgtaatatcgttccccatgatggtgatatgaatggggaagtggaaaagaaccccccaatttggcctgagataatgagattcttttcgaatcctcgcaaacccatgatacttgctcttgccaggccagaccccaaaaagaacatcaccactttagttaaagcatatggagaatgtcaccaactaagagagcttgctaaccttactctaattatggggaaccgtgatgaccttgatgaaatgtctaccacaaatgcagctgttcttctctccattcttaagctaatcgacaaatataatctatatggccaagtatcgtatccaaagcaccataagcaatctgatgttcctgacatttaccgtttagccgcaaaaacaaagggggtcttcatcaaccctgctttaattgagccatttggcctcactttgattgaggcagctgcttatggtttacctgttgttgccacaaaaaatggtggtcctgttgatattcttcgggttctggacaatggacaacttgttgatccccatgatcagcatgcaatagccaatgctcttcttaagctagtttcagataagcagctatggtcaagatgtagggagaatggacttaagaacattcatcttttctcatggccagagcattgtaggacatacttatctcgcataattagttgcaaaccaagagggccacagtggcagaataatgatgacaagttagataaatcagaatcagattcgccaggagattccttgagggatatacaggacatatccctgaatttgaaatttacattggatggagagaaaagtgaagggaacgccactttccttgaagaaaatgctgacgatgcaaagagtaatgtggagaacactgttttgacgttggcaaagggtgtattgagaggaattgcaaaaggcacgtcaactgagaaagccaatgaggatattggcgccggtgatttttcgacatttaggaggagaaaatggatatatgtcattgctgtggattgtgatgccactgcagattatattgacatcattaagaggattatggaagcaacaaggaaggaaaatgcagctggctttattctatcaacagccttgaccatattagaggtgcactcgctcttaacatcaggaggattgaacttgacggattttgatgcgttcatttgcagtagtggtagtgacttgctctatccatcatcgagctctgacgatggcccttcggggcttccctttgtcattgaccttgattaccgttcacatattgaatatcgttggggtggggaagggctgaggaagacattggtacgttgggcagcctccattaatgacaagaaggatggagaaaacattgttgcagaagatgaatcgggatcaagttcatattgcttttcatttaaagtggaagattatgatctgattcccccagtgaaggaactcagaaaactgatgagaatccaggcacttcgttgccatgttgtgtgctgtcagaatggcaggaaactcaacgttatccctgttttggcatctcgagttcaagctctaaggtatctttttgtccggtggggcatggatctgtcgaagttcgtcgtgttcgtaggagaatgcggcgacacggactatgagggactgatcggtggagtccataaaaccgtgatactcaaaggattaggctgtgaatctcgtaagttgcatgctcataggggttaccctctcgagcatgtcgttccatacgacagtcccaacgtcgcagaggcggaaggatctgatgtcgacagcattaaggaaacattagccaaattaggagtgacgaggacgtagcttctcccagtttgtgcattccttttgtctataaccaattggcttgtagaataaaaaactaagcctggtttgaacagagacatggagtctcagttattcaacgtcaacaccgaggccatgggaactatgcaagtaacaccgaggccatgggaactatgcaagtagctctttgagatgatgaattattgtctagaaaaacatgttacggcgtgaataataaccattctgttttagaaaaaaaaaacggcacgagagtacttctaga

SEQ ID NO: 187 - DNA, 1041 bp, Eucalyptus grandis
tctgtgttgaaggaatcagagaaatggcttcacccgcatgggctctgtttctgggtctcgttctgatggcttctggggcaatgggggctgctccaagaaagcctgtggcagtgccattcggtagaaactacatgcccacatgggctttcgatcacatcaagtacttcaatggtggctccgagatacagctctccttggacaaatacacaggtactggctttcaatccaaggggtcttacctgttcgggcatttcagcatggacatcaaattggttgctggagattctgcagggacagtcactgcattctacctctcatctcaaaactcagagcacgacgaaatagactttgagttcttgggtaacaggagtgggcagccgtacatagtgcagaccaatgtgttcacgggaggaaaaggagacagagaacagaggatttatctttggttcgatcccaccgccgcctaccactcctactctgttctctggaacatgtaccagattgtattcttcgtggatgatgtgccgatccgggtgttcaagaacagcaaggaccttggggtgaaattccccttcaaccagccgatgaaattgtactccagcctgtggaatgcggatgactgggccactcggggagggcttgagaagaccgactggtccaaggcgccgttcgtggcctcttaccgggggttccacatcgacgggtgcgaagcgtcggttgaggccaagttctgcgctactcagggccagaggtggtgggaccagaaggagttccaggacctcgatgccttccagtaccggaggctccggtgggtgcgctcgaaatacaccatctacaactactgtgccgatcggaagaggtaccctgcgatgtccccggagtgcaggagggacagggacgtctgatcaaattctgaatttggtggtcatgagagactaagaagctaagcatgaaagatgagcctaagaagatagatattggatgctatattgttgttgcttaagttatgttttaccactattcgttcatctaaaaaaaaaa

SEQ ID NO: 188 - DNA, 1066 bp, Eucalyptus grandis
aattcctctccttaatttcaaaaagccatggcttttcaaggcgtcctttcgaataagatggccatggcactggttgcccttggcctcttggtggcggccgcggcggcctccggcaacttcaacaaggacttcgacatcacgtggggtgatggccgtgcgcagatacccagcagtggccagctcctcacgctgtccctggacaagacgtcggggtcgggcttccggtccaagaagcagtacttgttcgggaagattgacatgcagctcaaactcgtgcctgggaactccgccggcaccgtcaccgcctattacctttcttctttgggttctgcgcacgacgaaatcgacttcgagtttctcggtaacctgagcggcgacccgtacaccctccatacgaacgttttcacgcaaggaaaaggaaacagagaacaacagttccatctctggttcgaccccaccaaggacttccacacctactccatcctgtggaaccctcaaagcatcatcttctctgtcgatggaacgcccataagagagttcaagaacctcgagtcgaagggcgtcgcgttcccgaagagccaggcgatgtggatatactcgagcctgtggaacgccgacgactgggccacgaggggcgggctggtgaagacggactggacgcaggccccgttcacggcctcctaccggggcttcaatgatgagcaggcctgcgtcgggtcgtcgggatcctcctcgtgttcctcctcctccggcgacaagtcttggctatcacagtcactcgacgccacaggccaacagagaatcaagtgggtgcagaagaattacatgatatacaactactgcgccgacaccaagcgcttctcgcaaggattccctcccgaatgctctctttcttagaagaaggaaaagaacacatgcaatatgatcaccaactttttccgtttttcttaggaacttagtactttctttcgtttatatcgaagtagtccctcttcaaattggcttgaactgttgaataatataaaaaagaagaaaagaaactaggcttgaatcgttaaaaaaaaaa

SEQ ID NO: 189 - DNA, 1201 bp, Eucalyptus grandis
cacctacatctctctctcctcttcagtcctcacttctcatattatcccattgagatttacttctcttcagcgagtacagcagcagcagcagcagcagtagcagcagacagaacacgcctaatatggcctccccttctgctccctcactttgcatcaccacactgcttctcgtggtcgtttcttgggcaacatctgcttccgcccgcaacttctatcaagacttcgacataacctggggagatggccgagctcagatcctcaacaatggcgacctcctcactctctccctcgacaaggcctccggctctggcttccagtccaagaacgagtacttatttggcaagatcgacatgcagctaaagctcgtccccggcaactccgctggcaccgtcaccgcatactatttatcttcaaacgggtcaacgtgggacgagatagacttcgagttcttggggaacttgagcggtgatccatacattctccacaccaacgtgttcagccaaggcaagggtaaccgagagcagcaattctatctctggttcgacccaactgctgatttccacacttactccatcctctggaatccacaacgcatcatattctcagtagatgggactccgatcagagagttcaagaatgcagagtccattggcgttcccttccccaaggcacagcccatgaggatattctcgagcctctggaacgcagacgactgggcaaccagaggcgggctcgtaaagacagactggacacaagcgcccttcactgcttcatacaggaacttcaatgccgataacacctgcatttggtcatctgggtcatcctcttgcacttcatcttcatcttcttcggatggtaatgcatggctatcagaagagctcgactcaacaagccaagagaggctgaagtgggtgcaaagcaactacatgatctacaactactgcacggacgccaaaagattcccccaaggcctccctcgtgagtgcgccatgtcctagacgacacaagacattgattttgtagaaaattctcctcgttttttccttttcttgagccaattctattcatttgttgatctctctctctctctctctctctatggagtcgagaagcaatagatattcttttattctttgacatttgtaacattcctatctttactcaatgaaacaaaaaatcttcttggatttcaaaaaaaaaa

SEQ ID NO: 190 - DNA, 1161 bp, Eucalyptus grandis
ccccacttctctctctcctctacagtcctcactctcaaatcatctcattggcatttgcatctcttcagcaactacagcagcagcaacaacagaaaacaaaacgcgcccaatatggcctctcgttccacttcttcgctttgtagagctgcgcttcttctcatggtcgtttcttgggcgacttctgcttccgcccgcaacttctatcaagacttcgacataacctggggagatggccgaggtcagatcctcaacaatggcgacctcctcactctctcccttgacaaggcctccggctccggcttccagtccaagaacgagtacttgttcggcaagattgacatgcagctcaaacttgttcctggcaactctgctggcaccgtcaccgcatactatttatcttcaaatgggtcgacgtgggacgagatagatttcgagttcttggggaatttaagtggcgatccgtacattcttcacaccaacgtgttcagccaaggcaagggcaaccgagagcagcaattctatctctggttcgacccaactgctgatttccacacctactccatcctctggaatccacaacgcatcatattctcagtggacgggactcccatcagagagttcaagaacgcagagtcgatcggcgttcctttccccaaggcccagcccatgaggatattctcgagcctctggaacgcggacgactgggcaaccagaggcgggctcgtgaagacggactggacacaagcgcccttcactgcttcctacagcaacttcaatgccgataacgcctgcgtttggtcatctgggtcgtcatcttgcacttcatcttcatcttcttcggatggtaatgcatggctatcagaagagctcgactcaacaagccaagagagcctgaagtgggtgcaaagcaactacatgatctacaactactgcacggatgccaaaagattcccccaaggcttccctcccgagtgctccatgtcctagacgacacaagacattgattttgtaaaaaattcgctgttctttttcttctttttcgagccaattctattcatttgttttgtggccgagaagcaattgatatttttttattctttgacgattgtagcattcctatctttactcaataaaacagaaaatcatcttggaaaaaaaaaa

SEQ ID NO: 191 - DNA, 1151 bp, Eucalyptus grandis
gcaaacacccacagctcttcctctctctccctcagtgtctcctcttcagtcctcactctcatatcatctcattggcatttgcatctcttcagcaactacagccgcagcagcagcagcaaaaaacaaaacacgccccatatggcctctcgttccacttcttcgctttgtaccaccgcgcttcttctcctggtcgtttcttgggcagcatccgcttttgcccgcaacttctaccaagacttcgacataacctggggagatggccgagctcagatcctcaatagtggcgacctcctcactctttccctcgacaaggcctccggctccggcttccagtccaagaacgagtacctgtttggcaagattgacatgcaactcaagctcgttcccggcaactccgcaggcaccgtcaccgcttactatttatcttcaaacgggtcgacgtgggacgagatagacttcgagttcttggggaacttgagtggcgatccgtatattcttcacaccaacgtgttcagccaaggcaagggcaaccgagagcagcaattctatctctggttcgacccaactgctgatttccacacctactccatcctctggaatccgcaacgcatcatattctcagtggatgggactccgatcagagagttcaagaacgcagagtccatcggcgttcccttccccaaggcccagcccatgaggatattctcgagcctctggaacgcggacgactgggcaaccagaggcgggctcgtaaagacagactggacacaagcgcccttcactgcttcctacaggaacttcaatgctgataacgcctgcgtttcgtcatctgggtcctcatcttgcacttcgtcttcatcttcttcggatggtaatgcatggctatcggaagagctcgactcaacaagccaagagaggctgaagtgggttcagagcaactacatgatctacaactactgtacagatgccaaaagattcccccaaggcgtccctcctgagtgcaccatgtcctagacgacacaagacataggatttgtagaaaattcttcgtttttttttttttcccctttgtgagccaactctattcattagttaatctccctctcgatgtactcgagaagcaattgataatcttttattcaaaaaaaaaa

SEQ ID NO: 192 - DNA, 1187 bp, Eucalyptus grandis
atcaacgcaaacactccacatctctctctcctcttcagtcctcactctcatatcatctcattgagatttgcttctcttcttcaactacagcagcagcagcagcagacagaacacgcccaatatggcctccctttctacttcttcgctttgcatcgccactctgcttctcgtggtcgtttcttgggggacgtttgcttccgcccgcaacttctatcaagacttcgacataacctggggtgatggccgagctcagatcctcaacaacggcgacctcctcactctctccctcgacaaggcctccggctccggcttccagtccaagaacgagtacttgttcggcaagattgacatgcagctcaagctagttcccggcaactccgctggcaccgtcaccgcatactatttatcttcaaacgggtcggcgtgggatgagatagacttcgagttcttggggaacttgagcggcgatccatacattctccacaccaacgtgttcagccaaggcaagggtaaccgagagcagcaattctatctctggttcgacccaactgctgatttccacacctactccatcctctggaatccacaacgcatcatattctcagtcgacgggactcccatcagagagttcaagaacgcagagtccgtcggtgttcccttccccaaggcccagcccatgaggatattctcgagcctctggaacgcggacgactgggcgaccagaggcgggctcgtgaagacggactggacgcaagcgcccttcactgcttcctacaggaacttcaacgccgataacgcctgcgtttggtcatctgggtcggcatcttgcacttcgtcttcatcttcttcggatggtaatgcatgactagcagaagagcttgactcgacaagccaagagaggctcaagtgggtgcagagcaactacatgatctacaactactgcacggatgccaaaagattcccccaaggcttccctcccgagtgctccatgtcctagacgacacaagacattgattttgtaaaaaattctcttttctttttcttcttttttcgagccaattctattcatttgttttgtggccgagaagcaattgatattcttttattcgttgacgattgtaacattcctatctttactcaataaaacagaaaatcatcttggatttcatagtaaaaaaaaaaaaaaa

SEQ ID NO: 193 - DNA, 1277 bp, Eucalyptus grandis
acaacatcacccatctctctctctctctcccccactctctctcaagccaaaatataagccaaagtataagccaaagtatagagcaatcatggcccatgaaggtggaggtcctagtgcttcctccatggtggtgttcgtgagcttgctgctgatggctgccgcttcgcccgcagctgggaacttctaccaggacttcgacctgacgtggggtggcagcgaccgcgccaagatcttcagcgggggtcagctcctgtcgctgtccctcgacagagtgtcggggtcgggcttccggtccaagaaggagtacctgttcggccggatcgacatgcagctcaagctcgtcgccgggaactccgccggcaccgtgaccgcttactacttgtcttcgcaagggccaactcacgatgagattgacttcgagttcctggggaacctgagcggcgacccttacatcctccacaccaacgtcttcactcaagggaagggcaacagggagcagcagttctacctgtggtttgaccccaccagaaatttccacacatactccgtcatctggaagccccagcacatcatcttcttggtagacaacattcctattagagttttcaagaatggagagtcaattggcgtgcccttccccaagaaccagcccatgaaaatatactcgagcctctggaatgccgatgattgggccacgagaggcggactgatcaagacagactggtcgaaagcgcccttcacggcatactacaggaagttccaggccactgcctgcacctggtccacgggctcgtcctcctgtgagatcggacggcccgcttcctactctggatccacatggaaaatcaatgagctcgatgcctatggccggaggcggctcaggtgggtccagaagtacttcatgatctacgactactgcgcggacggcaagaggttccctcaaggcatcccagccgaatgcaagcgctcgcgattctagagaagaaaaagagggaaatcaacgtgttcgaatggaaggtcgctcggcagtatatagttaatgcattctttcgtttcgtttcgcatgttcaagtcatgaattgctcgtgatgtcttgattccagggggaaaattaaaaaaaaaaaaaatggcctttgtacaatgtttcttgttgaaagttgttggggtggggcgctgaatattgctctgtaaagccacggttgtgacataaagatatgtttgtagcagtttgttctaccttgtgtaataaaactttgcattatctttcaaaaaaaaaa

SEQ ID NO: 194 - DNA, 1267 bp, Eucalyptus grandis
tcacccatctctctctctctctcccccactctctctcaagccaaaatataagccaaagtataagccaaagtatagagcaatcatggcccatgaaggtggaggtcctagtgcttcctccatggtggtgctcgtgagcttgctgctgatggctgccgcttcgcccgcagctgggaacttctaccaggacttcgacctgacgtggggtggcagcgaccgcgccaagatcttcagcgggggtcagctcctgtcgctgtccctcgacagagtgtcggggtcgggcttccggtccaagaaggagtacctgttcggccggatcgacatgcagctcaagctcgtcgccgggaactccgccggcaccgtgaccgcttactacttgtcttcgcaagggccaactcacgatgagattgacttcgagttcctggggaacctgagcggcgacccttacatcctccacaccaacgtcttcactcaagggaagggcaacagggagcagcagttctacctgtggtttgaccccaccagaaatttccacacatactccgtcatctggaagccccagcacatcatcttcttggtagacaacattcctattagagttttcaagaatggagagtcaattggcgtgcccttccccaagaaccagcccatgaaaatatactcgagcctctggaatgccgatgattgggccacgagaggcggactgatcaagacagactggtcgaaagcgcccttcacggcatactacaggaagttccaggccactgcctgcacctggtccacgggctcgtcctcctgtgagatcggacggcccgcttcctactctggatccacatggaaaatcaatgagctcgatgcctatggccggaggcggctcaggtgggtccagaagtacttcatgatctacgactactgcgcggacggcaagaggttccctcaaggcatcccagccgaatgcaagcgctcgcgattctagagaagaaaaagagggaaatcaacgtgttcgaatggaaggtcgctcggcagtatatagttaatgcattctttcgtttcgtttcgcatgttcaagtcatgaattgctcgtgatgtcttgattccagggggaaaataaaaaaaaaaatggcctttgtacaatgtttcttgttgaaagttgttggggtggggcgctgaatattgctctgtaaagccacggttgtgacataaagatatgtttgtagcagtttgttctaccttgtgtaataaaactttgcattatctttcaaaaaaaaaa

SEQ ID NO: 195 - DNA, 1209 bp, Eucalyptus grandis
aagtgagtggtgagaaacagagcgacttcagagctcgtgaagaaaagcttttgctctcgctcttcttcttcttcttcttcttcttcttcttcttcaatggctgtcccggtcttttccaaagtgtctgtgtcgttcggcctgttcgtgggtcttgcgttgttggtgggtctggtcgcgggtgcgaggtttgaggagctctaccagccgggctgggctatggaccattttgtctacgaaggagaggttctcaagctcaagcttgacaactactctggcgctgggttcgggtcgaagagcaagtacatgttcggcaaagttaccatccagatcaagctcgtcgagggcgactcggctgggaccgtcactgctttctacatgtcgtcggatggaccgaaccacaacgaattcgacttcgagttcctgggcaacactacaggggagccctacctggtacagaccaacgtgtacgtgaacggggtgggcaaccgggagcagaggctcggcctctggttcgaccccaccactgacttccactcctactccgtcctctggaaccagcgccaagtcgtgtttcttgtggacgagacaccgatccgcgtgcacaccaacttggagcaccggggcatcccgtacccgaaggaccagcccatgggcgtctacagctcgatatggaacgccgacgactgggccacccagggcggccgcatcaagaccgactggacccacgcccccttcatcacgtcctaccgtaacttcgagatcgacgcgtgcgagtgcccggcgaccatggcggcggcagacaacgccaagcggtgcagcagcgccggcagggagaggcggtactggtgggacgagcccacggtgtccgagctgagcctccaccagaaccaccagctcaagtgggtccaggcccaccacatggtctacgactactgcaaggacacggcgcggttcccggtcatgccagccgagtgcgagcaccaccgtcattgagcgaaaagtcccacgtgaattgtgatcgaccgggtcgatggtcatggaggttgttggattctagagggggatgggttgggttgttgtgaaaaagtcataagaaaaaccggacatgttctccgtgttctttgatatcttcctttctttgaaattttttggtggttgggtcttttgttgcagcatgtaatataatttcgattcgaatcaaaaaaaaaa

SEQ ID NO: 196 - DNA, 1180 bp, Eucalyptus grandis
gcatctccttcggtctcgtttcagtcggttcttcttgagctctagcctgttgtcatggcttctgctgcgctagcaatgattctctttacttccgttctgctcaaaagtttgatggttgcatctgctggcaacttaaaccaagagttcgacataacgtggggggatggccgagctcagatactcaacaatggagacctcctcactctctctctcgacaaggcttcaggctccggcttccaatccaagaacgaatatctcttcggcaagatcgacatgcaactcaagctagtccctggaaactctgccggcaccgtcactgcatactacctgtcctcaaaagggtcgacgtgggacgagatagacttcgagttcttgggaaacctgagcggcgatccgtacattcttcacaccaacgtgttcagccaaggcaaggggaacagggagcagcagttctatctctggttcgacccgaccgccgatttccacacctactccatcctctggaacccgcaacgcatcatattctcagtggacggcaccccaatccgagagttcaagaacgcggagtcgagcggcgttccgttccccaagagccaaccgatgaggatctactcgagcctctggaacgcggacgactgggccaccagaggcgggctggtgaagacggactggtcgcgagctccgttcacggcctcgtacaggaacttcaacgccgacgcctgcgtttggtcctcggggtcctcgtcttgcgggtccggcgccgcctccagcgacggcagttcttggctcacgcaagagctggacacgaccagccagcagaggctgaagtgggtgcagcagaactacatgatctacaattactgctccgactccaagaggttccctcagggcccccctccagaatgcaacctctcttaagggcccccctccagaatgcaacctctcttaagagagagagagagagggaatgctaggatttgaacataggacaattctttcattgaattttcgtattcttggatatgtttgacgataccttattattctttatgtaatatattatcttggttgattattttgcctcctttggcaatccagaacaatgaagagagcaatttggccacgtaaagagtgtattagcttatcgtataagaaagtcccatcttactgaaaaaaaaaa

SEQ ID NO: 197 - DNA, 1177 bp, Eucalyptus grandis
gcgttttgatatacatccctcctcccacaagacccggcagagaggactcgagagctttcttcatctctgctttcacaacttctcatgcaagattcaagaatggagaaaatggtttctccattgtcgattctcctctgcatctcgctcgttcttctggccgagccacgctcatcggatgcagcgccgcagtccaaggggtctttcgtcgacaacttcgacataatgtggtcggaggagcacttcaagacctccgcagatggccagatctggtacttgtctctggacaaagaaacaggttgcgggttccaaacgaagcagagataccgattcgggtggttcagcatgaagctcaagctcgtgggaggcgactcggccggagtggtcactgcttactacatgtgttcggagaacggggcagggccggagagggatgagctggacttcgagttcttggggaaccggagcgggcagccgtatctgatccagaccaacgtgtacaagaacgggacgggctcgcgcgagatgcggcacatgctctggttcgacccgaccgaggacttccactcctactccatcctctggaacagccaccagattgtgttcttcgtcgaccaggtgccggtcagggtgttcaagaacaacggcgaggcgaacaacttcttccccaacgagaagcccatgtacctcttctcgagcatctggaacgccgacgactgggccacgaggggcggcctcgagaagaccgactggaccaaggcgccgttcgtgtccacctacaaggacttcagcttcgacgggtgccagtgggaggaccccttcccggcctgcgtctcgacgacgaccaagaactggtgggatcagtacagcgcctggcacttgtccgaggatcagaagaaggactacgcctgggtgcagcggaacctcgtcatctacgactactgcaaggacacccagaggttcccgaccttgccttgggagtgctcgctcagcccttgggattgatcggcaagatctgctacagctagtttcggatcatgcggtccatccaattttccttatttattttgaccatgtgatatgtgtaattcgttttgtaagttcgcattattcattgatttctattcagttaatagattcagcacaataaaataaaaccctctttcttctaaaaaaaaaa

SEQ ID NO: 198 - DNA, 1667 bp, Eucalyptus grandis
ccttaaaaacgacgtccttctgtcttccttccattttagcctctctctttctctctctctctatcgcgcctagctgtcctgtatcagtattagagagatattcctcttctctctctctccctctctccctctctctctcagtccctctcttcttcttcttcttcttcatcactctcttccacatttctcgaccatatatatacacacataacatcatctttctgcacagaaggaggagcaggagggcaaaaatgttgcactcccatctgggcttgttgtccctgacctgctttgccgtcctccttgttctggcttctgggtcgtccccgaacctgcccatcatctccttcgacgaaggttacacccagctcttcggagacaacaacctcgccctccacggggatggccaatccgtccatctcgctctagacgagcgcacagggtctgggttcgcgtctcaggatctttacctgcatggcttcttcagtgcttccattaagttgcctgcggattacaccgccggagtcgtggttgctttctacatgtctaatggcgatatgtacgagaagaaccacgatgagattgatttcgaattcttgggtaacattcgggaaaaaaattggaggattcaaactaatatctacggcaatggaagcaccagcgttggcagggaagagagatatggcctctggttcgatccttccgatgacttccatcagtacggcatcctgtggaccgactctcaaatcatattttatgtggacaatgtacccatcagagagtttaagagaacggaggctatgggaggccaattcccctctaaacctatgtctttatatgccacaatttgggatggctctgattgggccacaaatggcggaaaataccgagtgaactacaagtacgccccctacgtcgccaagttctctgatcttgtcctgcacggctgcgcagttgacccgattgagcaccaattaagctgcaacgatgtcccaagtcataaggcgatccctcagggcatcagtcccagacagaggacaaagatggagtatttccggaagaagcacatgacttattcgtactgctacgaccgggctcgttacaaagtccctccgcccgagtgcgtgatcaatccaggagaagcagagcatctccgggttttcgaccccgtcacatttggagatggcaggcaccaccgtcccaagcgtcaccgccagagccggacgagccgggcagacgcctctatatgagagagataaacttcaattcaccaaatgcagcatttcgtggcttacttccactacattttacctacagtttgattgtcatgcctggtcaagtcatttctatttttttttttcccttcattttctgtttttttctttgcctgtgaataaaaaaagataaatagaggaaggagagaggagggggagggaaagaagggcacagagattcatcattggatttatatgggttcatgggggtggggtatgtgtatagttcatgataccgatagagttttccagccattttgtcatctcatatatgagtcttgtattttccttttgttttttttcctcttttttgctgaatttgaagatttgtactgctctctgagacatatctcctgggtttccaaataaatataccttttgtcaaaaaaaaaa

SEQ ID NO: 199 - DNA, 1487 bp, Eucalyptus grandis
aggcgcctccctatctccttctccttccctggcacgcctccgctttgtcattaacatgcgtgcacagcgcatcgcggacttcaccgaataaaaaggaagaaaactcgccattgattgagcaaacgaaaaatgtctgcttcgtggagtgtgacgagctgcttgttcttcgcttcctgcgcgcttctcgtcgttcttgccgtcgggtcaccggagaattcgaattcggagttgccggtcgtctctttcgatgaagggtacgcccacctcttcggagacgacaatctggtcattcacggagatggaaagtccgttcatctgactctcgacgagcgcacagggtctggatttgtttctcaggatctttacctacacgggttcttcagtgcttcgattaagctgcctgcggattacactgcgggagttgtggttgctttttatatgtccaatggggatatgtttgagaaaactcacgatgaaatcgacttcgaattcttgggaaacatcagaggcaaagaatggagggtgcagaccaatgtttacggcaatggaagcgtcggcgtcggcagagaagagagatataacctctggttcgatccctccgatgatttccaccagtacagtattctctggaccgattctctgatagtattttatgtggacaatgtgcctattagagaggtcaagcgaacaaaggccatgggcggagacttcccctctaaaccgatgaccttgtatgccacaatctgggatggatccagttgggctaccaatggaggcaaataccgggtgagctacaagtacgccccctacattgtcgagttctctgatctagtccttcatgggtgtgcagtcgatcctatggaacactcatcagcatgcgatgcagtccttccttcgggatcgatccctacagccatcacacgtgaacagagagtccagatggagagcttcaggaagaggcacatgacttactcgtactgctatgaccgagctcggtacaagatacctcctcccgagtgcatcctaagtgtgaaagaagccaagcacctccggtccttcgatcctgtcaccttcggccaaggcaagcggcattttgcgaagcgtcgccaccgccgtgtgtcggctacttccatgtgagttcgcgccaccaaccgactgtccattcgattctacaaggctgtctacagaatttatcctgtgaataggcggggagagagacgaaggcgatattggatattgacgttgggtcgacagatttcgcggcagatttcgtgtatagtttcgtgattccattatgtttgtgggccaaaagaatttgttattgatgttgtttgtctctgtggctattgctgaattcaatttggtgggtatgattcatgtacttgggcatatctcattgcttttttagcttcaataaacatgttcatggtgggggcatcagtctgcttgctcgcactcatataaaaaaaaaaaaaaaaaaaaaaaaa

SEQ ID NO: 200 - DNA, 1311 bp, Eucalyptus grandis
cctccctctctctctctaaaataacacatccactcgagctctcttgcatcatcgtctgccttcttccttgagaagaagcagcagaaagaagaaaggagacgatggctctgctctatctctcgctgctcctggtgcttctgatgttgccgatatgcccaggcaatgcccagtggcctccagcgccagggtactggccgagctctaggttcaggtccatgagcttctaccaggggttcaagaacctctggggccctcagcaccagagggtcgaccagagcgcgttgaccatctggcttgacagcacctcaggaagcgggttcaagtcggtcaagccgttccggtccgggtacttcggcgcatccatcaagctccaaccgggttacactgcaggggtcataacttcattctatctttcgaacggcgaggctcatccagggtttcacgacgaggtggacatcgagttcctgggaaccacgttcgggaagccctacacgttgcagaccaatgtttacatccgggggagcggcgacggcaggatcataggcagagagatgaaattccacctctggttcgatcccacccaggccttccatcactacgccattctctggagacccaacgagctcatattccttgtggacgacattcccataaggaggtacccgaggaagagcgcggcaaccttcccgatgaggccaatgtggctgtatgggtccatatgggacgcctcgtcgtgggccacggaggacggcaagtacaaggctgactaccgttaccaacccttcattgcgcggtacaccaatttcaaagcgagtggctgctctgcctactcgccggcttggtgccgccccgtctccgcctcaccctaccgctcgggcggcctcaccaggcagcaataccgcgtgatgagatgggttcaagctcaccacatggtctataactattgccgagactcgagaagggaccattcgctcactccagagtgcaggatttgaggaaggagggttcccccaagatttttctaaaagccacaagctcaagcacagggtcaattcatatgatttcactcttcacatgtatcgatttctattgggattttgggtttcttttctcttttttttcttttgaggtcaagaggagggctgtcttgagatgtaatttccccaccttgctacaaggacatttggagcaaggtttgttgagactcaagcgtccaaggctcccaaatcaaggggccaaaaaaaaaggtgtgaaaaagaaagtgtgtgtgaatgttgataataagatttttctattctgctaaaaaaaaaa

SEQ ID NO: 201 - DNA, 1038 bp, Eucalyptus grandis
ggttgatctcagcataattgacaaaggcgaagatgaagtatcttcgctcgtttcttgtcatcgtatcggtgttgaatttggtttgtgtttcattttcttccgtcgtgtcgaccgggaacttcaataaagacttcttcgtgatgtggtcgccggaccatgtgaatacttcggcagacggtcggactagaagcatggttctcgaccaggaatcaggggctggtttttcttccaatgacatgttcttgttcgggcaaatcgacatgaaaataaagctaatttcgggtcattcggccggcacagtcgtggccttctatctgacatccgatcagccgaaccgggacgagatagacttcgagttcctcggcaatgtgtccgggcagccttacatccttcaaaccaatgtatacgccgatgggttcgacaaccgcgaagagcggatttacctttggttcgatccgactcaggatttccacaactattccatcttgtggaacctccaccagattgtcttctttgtggattcaatcccgattcggacgtaccgaaatcacgcggacaagggggtggcgttcccgaggtggcaaccgatgggcgtcaaagccaccctatggaacggcgacagctgggcgacacggggcgggcatgacaagatcgactggtcgaagggccccttcgtggcctccttcggggactacaagatggacgcctgcgtctggaagggcaacccgaggttttgcagggcggagagccctacaaactggtggaacaatgaagatttcagctctttaacatcgacacagaggaggtggttcaaatgggtcaggagatatcacatgatatatgactattgccaggacaatgcaaggttccaaaacaacctgcccaaggagtgctctcttcccaaatactaaaactagcatagatacataagacatcatctccaattctttcatctcatcttcttctttctgtccacgtttgattcaattcgtgccaccaacatatttatgaaattggttcactggagtaaaaaaaaaa

SEQ ID NO: 202 - DNA, 1144 bp, Eucalyptus grandis
ccccaccaaaatcatcgtactacctgacccaaacatcctcatcctcctccgactccgaagcgcgtgctgctcttttggtctcttcagatttaagtcaaagacaggctgagatgacgtcgccctcgacgaggctctgcgtctgtttgttccatctggccgcgatctccgccctcgcctctgccggcaacttctacaaggacttcgacatcacctggggcgaccaccgttcccagatactcaacggcggccaagagctcacgctctctctcgaccaggcctctgggtccggtttcaagtccaagaacgagtacctcttcggaaggatcgacatggagatcaagctcgtggaaggcaactcggccggcacggtcaacgcatactacttgtcctctcaaggcccgacgcacgacgagatcgacttcgagttcctcggcaatctctccgggaacccctacacgctccacaccaacgtgttctcgcagggtaaagggaacagagaacagcaatttcacctctggttcgatcccaccaaggcatttcacacctactcgatcgtctggaacactcgacgcatcatattcttggtggacaacagtcccataagagtgttcaacaacttggagtcgatcggcgtgcctttcccaagcaaccaacccatgaggatttactctagcctctggaacgctgatgactgggcgacgatgggcggccgcgtcaagaccgactggaccaaagctcctttcaccgcgtctttcaggaacttcaacgccaacgcttgcgtggtctcgtccgggtcttcctcctgtggctcgaagtccaccaataacttgcagacaagcgcgtggcaggagcaatccctcaacgcggctggcaggaacaggctccgttgggtgcagcagaagtacatgatctataactactgcagcgactctaaacggttccctcagggtctaccgccagagtgcaagagatcgaggttcctctgaagctgaagctgcatcaacttccagtaccacagtcggttgattcttttgcgcaagatgtgatataaagtcgtgagcaaaattcattcattatttttttgtgtaactacaagtaatatcaataaaaggcaatttcgccaatattgctgtaaaaaaaaaaa

SEQ ID NO: 203 - DNA, 1158 bp, Eucalyptus grandis
ggttctttcgacaacccaagaaagtccaccacccactttcccacacctccatagtgtaaagaagtcccacttcaactaaacccgcgacttaaagcgtttgccaatgcccacctcaatttcttcatactcatttcctaggacgaccatgttggtcgtgtgcgcgatcctcatcggctcctccgtggttgccttggccggtaacttttaccaagattttgatgtcactttcggagatggccgcgtcaaggtactggataacggccagctcgtcaccctttccctggacaaggcctctggctccggcttcaagtccaagaaccagtacctctatggcaaattcgacatgcaaatcaagctcgtccccggcaactccgcgggcactgtcaccaccttatacttacattcggacgggtcgacctgggacgaaatagacttggagttcttggggaacttgagcggcgacccttacatcctccacaccaacttgtacagccaaggcaaaggcaatagggagcagcaattctatctctggttcgacccgacagccgatttccacacttactctgtcctttggaaccctgtacacgtcgtgtactatgtcgatgggattccaataagggagttcaagaacttgaatgccgcgggggtcccctacccaaagagccagcccatgaccctctactcgaccctatgggacgctgaggactgggccacccggggcggcctcgtgaagactgactggtcgcaggcgcctttcaccgcctccttcagcggcttcaacgcgagcgcttgcgtctggtccaacggagcctccacttgcctttcttcctcggccgcctcggcgaaatacccttggttttctcagcaacttgatgccgcgagcctgcagacgatgaagtcggtccagcagaagtacatgatctacgactattgcaaggacaccaagcgattccctcagggcctacccctggagtgcacgcttaagaccaagtcatgagatcatgcacataagcaaaaatatgataatgttcgcacatatgccttcatatcattaatttgtcaagtattgtgattaattcgtacgccgtggatgtacatgagacgtgctcatggtttaccaagtcaataatatgtttgattaattggataaaaaaaaaa

SEQ ID NO: 204 - DNA, 1159 bp, Eucalyptus grandis
ggagatatggccctcctccaagaaaatacactcttcttctctctcctcttccttctttgcatggccatatctgtttcttcacataacaggccttacagccctccggacgtccctcgcttgacagatttattccctcatgtcgcagtcgatcaagggttctccaagttcttcggagctcaaaacgttcggctgctgaataatggttcatacgccaatcttgctctcgacaagtcctcagggtccggtttggtctcgcgaagcaaataccactacggattcttcagcgccgcagtcaagcttccagctggtctttcatctggtgttgtagtggccttctatttgtctaatgcagatgcattcccacacagccacgatgagatagacatcgagttgctcggtcatgataagagaaacgactgggtcctgcaaacaaacatatactccaatggcagtgtcagcactgggagagaagaaaaattctatttctggttcgatcccacccaagagcaccattactacagcatcatatggaacagccatcatattgtgttttttgtggataacataccagtgagagaattcccctcaagtggtgtcttctcttccacatacccatcaaagccgatgtctgtgtacgcgaccatatgggatgggtcacagtgggcaactcatggaggcaaataccctgtgaactacaagtatgcaccattcgtggtctccttagcagagacggagatggtgggttgtgtctcaaatccaagacaacagccactgagttcatgttccaaccagagcacatcgtcaggctcggacccagtggagggtcaggattttgccgccctgtctcagcagcagatcacggccatgcaatgggccaggagcaagctcatgttctactcctactgtaaagacacttccaggtttaaggtgatgccaccagaatgcaagtaaatccttcttctaggttcttttccttttctgaattttctctgtttatttattcccctagaaataaggggcgatgacacttcaactatatgttttgggcctataattccattatacgcctatacatactgacgttgtcctgcgaagccctgtttttctgggttaaagaaagattttaatgttcattatagatcctccttaaaaaaaaaaa

SEQ ID NO: 205 - DNA, 1324 bp, Eucalyptus grandis
ggaaaaggagaaagaaactttttagccaacaccagaaaatttttatggatcctttgcgtcgcctcgtctctctcgcggttacgacttcatcctcatcatcttcgtcgtcctccttgactcttctgctcgcgctcctcttctacgccgccagcgccgccgcggccttcgacatcgtccccatcaccttcgacgaggcctacgctcctctcttcggcgactccaacgtcgtccgctccggcgacggcaagagcgtccgtctcctcctcgatcgcttctccgggtccggttttatctcctccaatctctacaagtatggcttcttcagcgcgaggattaagctgccgtccgactacacggccggcatcgtcgtcgccttttatacgtcgaatggcgacgtattcgagaagacccacgacgagctggacatagagttcctggggaacataaagggcaagaaatggaggttccagacgaacgtgtacgggaacgggagcacgagccgagggagggaggagcggtacacgctctggttcgatcccaccagggccttccatcgctacagcatcctctggaccgccaacaacatcatattttacgtggacgaagtccccatcagagaaataatccggaacgacgccatgggcggcgacttcccggcgaaaccgatggccttgtacgccaccatctgggacgcctccgactgggccacctccggcggccgctacaaggtcaactacaagtacgccccctttgtcgccgagttcaaggaccttgtcctccagggctgccctgttgaccccatcgatcagtactcctccggacactgctacgacaagctcgccctcctcgaggcccaggacttcgccaccgtcactgcacagcggcatgcggccatgcggcggttccggcagaactacatgtactactcctactgctacgacaccgtccggtatgcgattcctccgccagagtgtgtgatcctccagtcagagaaggagcggttcaaggacaccgggcggctcaagttcggcggcagtcacaagaagcggtcgcggcggagggggcatcggataccgttggtgtcggaggagcagcccgtgatgtagtttgatcgtcagctgtaattacatgtgcctagactttttttttttatctcattttatttcttctaatttttgtggctccaggcagataatacgagggggaattttcgcatgcatggcttgaataatcaaattgaatattgagaatcatctcaatgtttactatgtatattattgattgtcaatatgtgtaatcataagtcaccttcagaaaaaaaaaa

SEQ ID NO: 206 - DNA, 1230 bp, Eucalyptus grandis
gaggagagagagagaaaaagtctcaaagacaaaagccatggatcgtcatcctcctcctcattcccgtcgcttctctctctaccaaccaccttcctatttttctctctccctcctctccatcttcatcttctcctgcttcctttccacgtccgatgccgccttcgacgtcacccccatctccttcgacgagggctaccggcctctcttcggcgacggcaacgtcgtccgctcccccgccggcgacggcgtccgcatcctcctggaccgcttcaccggatccgggttcatttcttccgatatgtatcaacatgggttcttcagcgcgaagatcaagttgccgtccgactacaccgccggcgttgtcgtcgctttctatacgtcgaacggcgacgtgttcgagaagacgcacgacgagctggacatagagttcctgggcaacataaggggcaagccatggaggtttcagaccaacgtctacgggaacgggagcacgagccgcgggagggaagagcggtacacgctctggttcgatcccaccaaggaataccatcgctacagcatcctctggaccgccaacaagatcatattttatgtggatgaagtgcccattagagagatagtgaaaagtgaggcaatgggtggtgacttcccatcgaagcccatgtccctctacgccaccatttgggacgcctccgactgggcgacctccggtggccgatacaaagtcaattacaagtacgcaccatttgtggctgagttcaaggacctcgtcctcgagggctgcatggccgacccaatccggcaactcccggcctcgggctgccatgcgaaggatgcccagcttgaggccagggacttcgccaccatcacgtcgtcccagcgccgcgccatgcgccggttccgcgagcggtacatgtactactcctactgctacgatactctgcggtaccctgtcccaccgccagagtgcatgatcatcccatcggagaaggcacggttcaaggacactgggaggctcaagtttggcggcagccacaagcgccggtcaaggcggagggagcggatcccagctgcgtcagtctcggataatcaggcctctatgtgatgggtcatacaataatcatatatgtaaattggcttcactctcttatagaaatttgtggaataattgaggggatgatatagtttggtccgtgaatatatttttttcattttttggaaaaaaaaaaa

SEQ ID NO: 207 - DNA, 1235 bp, Eucalyptus grandis
cacaagcctcttcactagctggttcttgaaatttggctttctgggtgatgtcgcatccgagaactcagatggcaatctcgaagcggcggtctccttcatgctccttgatcgccttgacgatgatggtgtggttatggagttctcatgtggttccgagggtagccggttgtgacggcttcgacgagctctttcaacccaattgggctcctgagcacttcgagtgtgaaggggaccaaacgaagttgactcttgattcttcttctggttgtggatttgggtccaggaaggcatacctgtttggactgacaagcgtgcaaattaagctggtccaaggcgattcggccggaacagtaacggcattctacgtatgcaatcatccctactcatctgcaatcataaagtgtttccgaattccggtatgcaaaaactcacagatgaaataccactgcagatgtcttcggacgggcccaaccacgatgagcttgacttcgagtttctgggaaacctatccggagaaccttaccttgtacaaaccaacgtctatgtcaacggcaccggagatagagagcaaaggcacagcctttggttcgaccctaccacggattttcacacctactctttgttctggaaccggcgttatatcacgtttctggtcgatggaattcctataagagtgttcgcgaacaaggaagagtcacacggcgtgccgtatccgaagaaccagcctatgcgtgtccttggttcggtgtggaacgccgacgattgggctacccaaggagggagggtgaagacgaactggagccatgcgccttttgtctcttcgttcagggccttcgacatcgacgcctgtgagctgtcgccggagacggccgatgtcacgaccaagtgcgggcaattggggcgatactggtgggacaggccgtcgttcaacgagttaggccggcgccagagccgacaactgaagtgggtatgcaagaagtacttggtctacgactattgcgaggacaagcccaggttttctgagcttcctaaggaatgtgtggggtagcattggcgacatgtctgtcgatttttatgtacaagctgctcctactcataaactgacagctttaatcctgcgcaccgtgcgagcctaataattagtgtaacttttaagattcaaggtctgatcttaacctcaatctgagaaattaatttgcaatgtgcacaagatcaatgtcgaccgaaaaaaaaaa

SEQ ID NO: 208 - DNA, 803 bp, Eucalyptus grandis
taacgtcgacgagatggcgaagccaggtttaacggcaatggtggtggcagctcttgctctggtggtggcaatggtggcgacacttgcccatgccgaagcggatgaccccaagaaggtggacgcttggttcaatgggcttagccatgccgatcgcaagaccacacgcctccacttctacttccacgacacgctctctggcaggaaccccacggcagtgcgcgttgccgaggccacgatgaccgagaagtccccgacgctttttggggtggtcaacatgatcgacgacccactgaccgaggggcctgagccggagtcccccctcgttggccgggcacaggggttctatggctcagttgggctcgagtcgatggccctgcacatgaacatgaacctcgtattcacgaccccggagtacaacggcagcaccctgagcatattgggccacaacccggcactcgagacctatcgggagatgcctatcgtcggtgggaccggcgttttccggctggcaagtggggtcgtgacggcgaagacgtactttctcaacctcaccaccggcgatgctgtagttgaatataaggtcatagctttgcattactagatatatcgtggcttgtgttgtagtcaagtccaaaggttatggaggaaattacatcgttctagttgtgtgcggatgctctatcgtttccaatttggttatgctctacgtgctttgtgatttttcattgattttggtggtctggaatcttcctgtgtgggctctagatgaactataaattggactcgatttatcaaaaaaaaaa

SEQ ID NO: 209 - DNA, 981 bp, Eucalyptus grandis
caattgtctagagtaatgtaattttctgatgtgaattctttctattctagaactgaatgcacctgttggtctgtgtatttctgcaggtgtcttctttataaggctcctttctgggttcatttccgcctctaaattccttccaatagtgtccactttcccagcaatttcagatcgagagacagagatggcgaagccaggtttaacggcaatggtggtggcagctgttgctctggtggtggcagctgttgctctggtggtggccatggtggcgaaacacgcccatgccgaggcggatgaccccgagaaggtggacgcctggttcaatgggcttagccatgccgatcgcaagaccacacgcctccacttctacttccacgacacgctctctggcagcaaccccacggcagtgcgcattgccgaggcgaagtccccgacgggtttcggggtggtcaacatgatcgacgacccgttgaccaagggccctgagccagagtccccccttgttggccgggcacaggggttctatggctcagttgggcttgagtcgacggccctgcacatgagcatgaacctcgtattcacgaccccggagtaccacggcagcaccctgagcatattgggccgcaatccggcactcgagacctatcgggagatgcctatcgttggtgggaccggtgttttccggctggcaagtggggtcgtgacggcgaagacgtactttctcaacctcaccaccggcgatgctgtagttgaatataaggtcatagctttgcattactagatatatcgtggcttgtgttgtagtccagtccgaaggttatggtaggaaattacatcattctagttgtgtgcggatgctctgtcgtttccaattttgttatgctttacgtgcttcgtgatttttcattgattttggtggtctggaatcttcctgtgtgggctctagatgaactataaattggactcagtttaaaaaaaaaa

SEQ ID NO: 210 - DNA, 923 bp, Eucalyptus grandis
aaattctttctatcaatcgattgtgctcgaaaatgggtgcaagagtaatcgtttcgctcctcttcttgttcctaattttcggctccaacgccgatgcagcaaacaagcgcatccgcaatcgccgcccatgcaagcggctcgtgttcttcttccatgacgttctctacaatgggaacaacgcgaagaacgcgacctcggccataatcggcgcgccggcttgggccaaccagacgattttggccgggcaaagccatttcggcgatttggtcgtgtttgacgaccccatcacgttggacaacaatttgcactcgaagcccgttgggcgtgcccaagggttctatatctacgacaagaaggatatcttcacagcttggcttggcttttcgtttgtgtttaattccacccagcacacgggtagcttgaacttcgccggggctgaccctttgatgaacaagaccagggacatttcggtaattggcggcaccggcgacttcttcatggcccgtggcgtggctactctgatgacggactcgttcgagggagaagtttacttccggcttcgcaccgacattaagttgtatgaatgctggtagtggattcattatagcgtcaacgttgttaggatacaagggaaggtaatgtgcgcaactgaagtggaagaaatgacaagtactgagactttcaaataaagttctgcaaatctattgttccccccttctgatgaagttttcctttgatatattagttgtcttattttatcttatcccacttcgtggtggtatgctagttacatgcgagctggtcccaagacactgtatggctttggtccgagtttccgcttttagggtttcatcatcacagtttttgcagctgtggtagcgagattatcgccttatcaagaagacttcctcgcaaaaaaaaaa

SEQ ID NO: 211 - DNA, 803 bp, Eucalyptus grandis
gtgaagcacctcatggccacactcagtccgatctcgtctctcctcctcctcctcctcctccttctctcctctggtagcccgacgctcgcctccgcctttgcgaccgccctcgacccgagccttatgggcatcaacctcgggaaggagaagctcagccacttccgcttctactggcacgacgtccagagcggcccccaccccagctctgtcaccgtcgtgcccccgccgtccaactcctcagccaccttcttcggtctcatcaacatgatcgacaaccccctgacccttcgccccgacccggggtccgagctcgtcggccgcgcccagggcctgtactcgtcggcgtcgcaggaggaggtgggcctgctgatgatcatgaacttcgccttcgtggcggggaagtacaacggcagcggcatcaccgtgctggggcggaacccggtgctccagaaggtgcgggagatgccggtgatcagcggctgcgggctgttccggttcgcccgcgggtacgcgcaggcgaccacccacacgttcgaccggaagaccggcgacgccgtcgtcgagtacaacgtctacgtgttgcactattgacgtttggtgatgtgatcatgatcggtttactttttgggcctttttcttatcccctttcgcttattgactgttaccagcttttttctctttcaaattcctagggttctagaaatggcaatcatagctgccacttatgatttccaggtttgcttatggtccaaggaaaatggagtcggtaggtggatttctgaccaaaaaaaaaaaaaaaaaaa

SEQ ID NO: 212 - DNA, 1190 bp, Eucalyptus grandis
tagcacctccatggcaactctcatccccatctcctcgctcctcctcctcgtcctcctctcctccgccgcgccggcgccggcctccgccttcgccaccgccctcgaccccagcctcatgggcgtccacctcgggaaggagaagctcagccacttccgcttctactggcacgacgtcctgagcggccccaaccccagctccgtccgcgtcacgaccccgccctccaacgcctccgccaccggcttcggcctcgtcaacgtgatcgacaacccgctgaccctcctccccgacccggcgtccgagctcgtcggccgcgcccagggcctctactcgtcggcctcgcaggaggaggtggcgctgctgatgatcatgaacttcgccttcgtgtccgggaagtacaacggcagcggcatcaccgtgatggggcggaacccggtgttccacaaggtgcgggagatgcccgtgatctcggggtgcggggtgctccggttcgcccgcgggtacgcccaggcgagcacccacacgttcgacctcaagaccggcaacgccgtcgtggagtacaacgtctacgtgctgcactattgatcatgattgattggtttacttttgttgccttttgtagaccttttttgctttatctttagtggatggtccccagcttttctccagttccatcttttttgtggtcgataataatgcaggtatatcattacatccagctacgagtgatctcgagattaatttatgcagaaaggcggaaaatttaacaccttccattccaaatttcctttacgcaatcttcgtgtgcactaagattagtcggtggaattggtttattaagtcattcgacatgtagtgagcagtcgtttgattcgattgattagaccgtgttccatgatggattgtaattcgtcacgtgaattggtaatttgattttgtaagttgatgttgataattctagggtttctctagttgtcaagcatgtccaggtgcaatgggccaccggggctttggagaaagaaagggcatgatgcccgtacatttcttttcagactagttatatacccgtgacctagttatatacccgtgacctgggcaccacgagagcatcgatgaattttattatttcagtcacaattctttagacacgtttctaatcctccaatctaccaatcaaaaaaaaaaaaaaaaa

SEQ ID NO: 213 - DNA, 695 bp, Eucalyptus grandis
gcgatttcagatcgaaagacagagatggtgaagccaggtttaacggcaatggtggtggcagctcttgctctggcgcttgccacggcggtggcgctcgcctgtgccgaggtggatgaccccgagaaggtgaacgcctggttcaataggcttagccacgccgagcacaagaccacacacctccacttctacttccacgacacgctctcgggcaagaaccccacggcggtgcgcatcgctgaggccacgatgaccgagaagtccccgacactgttcggggtggtcaacatgatcgacgacccgctgaccgagggtcctgagccagagtcccccctcattggccgggcacaagggttctatggctcggttgggctcgagtcattggccctgcacatgaacgtgaacctcgtattcacgaccccagagtacaacggcagcaccctgagcatattgggccgcaacccggcacttgagacctatcgggagatgcccatcgtcggtgggaccggcgtttttcggctggcaagcggggtcgcgacggcgaagacgtactttttcaacctcaccactggcgatgctgtagttgaatataaggtcatagctatgcattactagacacttagtagatacatcatggcttgttgtagtccggtccaaaggttatggagtaaattacatcgttgtagtcaaaaaaaaaa

SEQ ID NO: 214 - DNA, 742 bp, Eucalyptus grandis
atcgcccttctttaggtcgccatttcttcttcatcaaatggcactaatctcagctcccaaaatgctcacggccacgacgttctcgcaacttcttctcctatccacttactcaattctcatgcattcctattcatcaaaggcaaccgtccagcatccacacaccactaagctggtgttgtacttccaggacatcattgccgggcccaatgccaatgacatccccgtcgtgggcatccccgggaagctctggtcgttcagccagtttgggacggtgttcgttgctgatgaaccaataaccgagacgccggaccccaactcagccatggtcgggcgggcacagggcatgtatgtgatctcgtcgttggacgggtcgaatgttaaaacggtgttctcgattgtgttcaccaaccaagcctacaacgggagcaccctagagctccagggcgcaggcaagcagctccagagggtcctcgagtttgcggtggtgggggggacggggaagttccggtttgcacggggctacacgacgctcgagactatctcattttcacagggtcatggagttatccaattcaatgtcactgttcgtcatgattagaggagatttcatatatgttcgacaaattttgtatggattaaataatattgggataggatgttgtgtgctccgtctgggcactaataaataaaacgtactctataaggatccgtcttcttttagatgtcattaataaaaaaaaaa

SEQ ID NO: 215 - DNA, 761 bp, Eucalyptus grandis
gccaattgctagcaactacgcatagttaaccatgagaaacttggtcgcacacaaatcatgcttccttgtcctcttcctcctcctcctcttcacaagccagttctcatcggctaccaagaaaaccttcaacagggaccaaccatgcaagaggtttgtcctctacttccatgacatactctttggtggcaacgacgtggccaacgcaacgtctgcagcggtcgctaacgagacggggcttggcaacttcaagtttgggaagttgttcgtattcgacgacccgatgacgaaagataaaaattatctctccccagcggtcgctagagctcaaggcttctatttctacgacatgaagaatgactacaatgcatggttcgcctactctttggtgttcaattcgacagaacataagggaactttgaacataatgggtgcagatataatggcggctcaaactagggatctttccatcgtgggcggaaccggagatttcttcatggcgagaggcatcgcaaccttcgagaccgatctttttcaaggagccaagtattttcgcatcaaaatggacatcaaactgtatgagtgttattagacacgctttgtacctcgagggttgaattctagcgaggacttttgtttatcattgtctcttaggaataaaaccgctatctcattttgttcgaatacatataagaacttattgtatggaagatccgtctttcatgtttaataattaaataaaatctccatgcgcaaaaaaaaaa

SEQ ID NO: 216 - DNA, 647 bp, Eucalyptus grandis
atggctgttcacatcgcaaagcttgtagccttctctctcctctgtatgtcgaccgtttttgtcgccgcaaactctcataccttcgcgcgcagcctcctccctcaagagctcgggctcaagaaggagaagctgagccacctccacttctacttccacgacatcgtgagcgggcgcaacccgaccgccgtgcgcgtcgctgaggccaagatgaccaactcgtcggccacagggttcggggccgtggtcatgatcgatgacccactgaccgaaggccccgagatgagctccaaggaggtcgggcgggcccaaggtatctacgcgctgtcgtcgcagaacgacgtcgggctgctcatggtgcagaactacgtgttcactgaggggaagtacaacgggagcacgctgagcgtgctcggccggaacgcggtgttctccggtgtgcgggagatgtccatcgtcggcgggagcgggctcttccggttcgcccgcgggtacgcacaggcaaagacgcacacgatggaccgtaagaccggggacaccgtcgtaaattacaatgtttatgtcttccattattgatccatgttcacgagatgtctttgaaggcctttgtggaaagatttctcacatttagttaaaaaaaaaaaaaaaaa

SEQ ID NO: 217 - DNA, 885 bp, Eucalyptus grandis
acaccccccaccacaactgctctaacagctcctccacttcctttccgtttcctgatactgactctaggaggagccaagcccatggctagtgtttcccgtgtggttggccttgtctctctgatactgttttcgacgctggccgaggccagaatcccgggtgtctacactggcggtccgtggcagagtgcccatgccacattttatggtggcagcgacgcatccgggactatgggtggcgcgtgcgggtacggcaacctgtacagccagggctacggcgtcaacaccgccgcgctgagcacggcgctgttcaacaacgggttcagctgcggcgcgtgcttcgagatcaagtgcgcgaacgagccccagtggtgccactccgggagcccgtccatcctggtgacggcgaccaacttttgccccccgaactacgccctgcccaacgacaacggcgggtggtgcaaccccccgcggccgcacttcgatctcgccatgcccatgttcctcaaaatcgccgagtaccgcgcagggatcgtccccgtgtcctaccgccgcgtgccgtgccgcaagcaaggagggatcaggttcacgatcaacgggttcaggtacttcaacctggtgctggtcaccaacgtggccggcgcgggggacatcaacaagctgtgggtgaaagggtcgaagaccgggtggatgagcatgagccgcaactggggccagaactggcagtccaactccgtcctcgccggccagtccctctccttccgggtcaccgccggcgaccgccgcacctccacctcctggaacatcgtcccgtccaattggcagttcggccagaccttcaccggcaagaacttcagggtctagcctcactcccaaccaaaaaaaaaa

SEQ ID NO: 218 - DNA, 1119 bp, Eucalyptus grandis
gcacacccctctctctctccccctctccctctctctctccaagtccagcttcactagcagcttagagcagagacaatggctgcagcaagagtgatggctctggctcttgcatttctcggtgtcgccctgtccgcaacacggatggctgaagcaagaataccgggcatctacactggagggccgtggcagagtgctcacgccaccttctacggtggcgctgacgcctccggcactatgggtggagcctgcggctacggcaacctctacagccagggctacggcgtgaacaccgccgcgctgagcaccgcgctgttcaacaacgggttcagctgcggcgcgtgcttcgagatcaagtgcgccaacgacccgcagtggtgccactcgggcagctcctccatattcgtcacagccaccaacttctgccccccgaactacgcgcagcccagcgacaacggcgggtggtgcaaccctccccgcccccacttcgacctcgccatgcccatgttcctcaagatcgccgagtaccgtgccgggatcgtccccgtcgcgtaccgcagggtgccctgccggaagcggggcggcatcaggttcacgatcaacggcttccggtacttcaacctggtgctgatctccaacgtggcgggcgcgggggacatcgtgagggtgagcgtcaagggctcgcgcacgggatggatgagcatgagccacaactggggccagaactggcagtccaactccgtcctcgtcggccagtcgctatcgttccgggtcacgggcagcgaccgccgcacctccacctcctggaacatcgtccccgccggctggcagttcggccagaccttcaccggcaagaacttcagggtttgactccggcgttgaccgggggctcattttatcaagatttttatttaagggatacaacatcagggtccgagactgatggtttactgattattgtaaggcgagtgaggtatagaaatgtagctgaagcggctgcacgaacgcattgtagcccgcagcttatgatagtgatatagggtgtgatatatttatactttcgatatgggtgtgtacgtctcgatgaccctattataatcatatgatttgagaaaaaaaaaa

SEQ ID NO: 219 - DNA, 1299 bp, Eucalyptus grandis
cttcttctctctctctctctctctgtgcgcttgtgaaacgagcattttgctagcgagcgaggaagagagaaatgactcgagcaagcgtggtgtttgcagcctccctcatctcattctccctaatgtggctcgccgacgccaggatccccggcgtctactccggcggcccctggcagaccgcccacgccaccttctacggcggctccgacgcctccggcaccatgggtggggcctgcgggtacgggaacctgtacagccagggctacggcgtgaacacggcggcgctgagcacggcgctgttcaacaacgggctgagctgcggggcgtgcttcgagatcaagtgcgcgaacgaccccacgtggtgccactccggcagcccctccatcttcgtcaccgccaccaacttctgccccccgaacttcgcccaacccagcgacaacggcggctggtgcaaccctccccgcccccacttcgacctcgccatgcccatgttcctcaagatcgccgagtaccgcgccggcatcgtccctgtctctttccgccgggtgccgtgccggaagcgaggcgggatgaggttcaccatcaacgggttccggtacttcaacctggtgctgatctcgaacgtggcgggggccggggacatcgtgcgggtgagcgtgaagggggcgaggaccgggtggatgagcatgagccgcaactggggccagaactggcagtccaacgccgtgctggccggccaggcgctctccttccgcgtcaccgccagcgaccggcgctcctccacctcctggaacatggtccccgccggctggcagttcggccagaccttcaccggcaagaacttcagggtctgaggagcgaagcctcttttaattcaccgttttgtcctcgccgcgccattttcccactctccagaatgccctgttccttttcattttctcgttttgctgttttaactcgtaaggtgttggggaatgtaaaagtgcacggagcgtcagacttcttttttgactttttgattggtgggtcttttttttccgttttctgctttccattttcttttcttttttgggggtgaagtgttgagtgggggggattgtttggttagtagggaaggaggaatgttagaagacatcctagggctgaggaggcgtctgcacaagcacgtggcccgcagctgatatggcacctatgaagcactagtagtagaccagtaacattatgctcgagcaagtttgagtatgtgtatctataatttattatatatatatatatgtatgtgacacgttaaaaaaaaaa

SEQ ID NO: 220 - DNA, 1527 bp, Eucalyptus grandis
ctcgtgccgctacagagcagcctacagagctacgcgccctcgctgtaaaaagtgtcggcgagcgccttttcgaggcttctcttcctccctttgcccccccccccccccgtccttcctctcttaaccgtccctcggtttctccgctgcgaccttgtggcgggaacaatgcagcagcgccgccgcggctccccctcctcctcctcctccgccgccgccctgctcctcggccggctctggctcctgctggtgctgggggcggcgacgacgagtgcgtccgcgcaggtgaagaagcgagtgcccaacgcgcggtggaagcccgccacggccacctggtacggcagccccgacggcgacggcagcgatggtggggcgtgcgggtacgggtcgatggtggacgtgaggccgctgcgggcccgggtcggggcggtgagcccggtgctgttcaagaacggcgagggctgcggggcgtgctacaaggtgaagtgcctggaccggggcatctgctcccggagggccgtcaccatcatcgtcaccgacgagtgccccggcgggtactgctccggagggaacacccacttcgacctcagcggcgccgccttcggccgcatggcgatcgccggcgaggccggcccgctccgcaaccggggcgtcctccccgtccagtaccggaggacgccgtgcaagtatccaggcaagaacatagccttccacgtgaatgaggggtccacggactactggctctcgctcttggtcgaattcgaggatggagatggcgacgtgggttccatgcacattaggcccgcgagttcgagcgagtggatagagatgaagcacttgtggggggcgaactggtgcatcaccgggggtcctctgcaaggccccttctcggtgaagctgacctcattgtcgaccaacagaacgctctcggccagagacgtgatcccggggaactggtctcccaaagccacttacacttctcgcctcaatttcttctaaatcccattcatccgccataagcatcccctctactcggcatcacatcacaaaggagctttcgtcggtgctttttggaagaaaagtagccagtgggagctgcataattgatcggcatcccatgctctttcttcttctccttatgcttattttcgatcttgatttgtactttttttcctcatgtaagtgtttgtgttggtgtttgtgttgtgtagttgatgtagccctctccaaagggagagagagcgtgcataggctttgcaatagaatgtgtgtagattgggttggtgcggggttaacgagattgttgtgggccatttgtcttgtcttgtcttgtcttgatgactttggaccgctcgaattgaaatcttgctggtcgatccatgtgaggggagacaaaggtcaggacttgtggccctgtggggacccttgtgagtttgtttcttccatcgatgaagtagaagctgaaatgtaattgttcgagttactcgcagaatcggagtgatgtatctagtggctatcttaaaaaaaaaa

SEQ ID NO: 221 - DNA, 1180 bp, Eucalyptus grandis
aagcaccaaacactaaccagcaaacgctttcatctcctctcctccctcaatctctgtctttctactgctatattcttttttagcaaagccaagccacatcagaaaaaagaagcaagaatggctaattttgcagcaatctcggctgttgctcttgtgttcctgtgtctcaaaagtgcttttggggattatggaggctgggaaggcggtcatgccacattttatgggggtggcgatgcatctggcacaatgggaggtgcttgtgggtatggcaacctgtacagccaaggctatggcaccaacactgcagctttgagcactgccctgttcaacaatggcctgagctgcggggcatgttacgagatgcggtgcaacgacgaccccaggtggtgcctcccggggaccatcatggtcacggcaaccaacttttgccctcccaacttggccctctccaacgacaatggcggctggtgcaacccccctctccagcacttcgatatggccgagcctgctttcttgcagattgcccagtacaaagctgggattgtcccggtttccttcagaagggttccgtgtgtgaagaaaggaggggtaaggttcaccatcaatgggcactcctacttcaacttggtgctgatcaccaacgtgggaggtgctggtgatgtccattccgtttccatcaagggctcgaggactggttggcaagccatgtcaaggaactggggacagaactggcagagcaacgcctacatgaacggccaggctctctccttccaggtgaccacgagcgacgggaggacggtgaccagctacaacgccgcaccggccaattggcagtttggacagacatttgaagggtctcaattctaagaatctctagaggtcttcgaggtgtgactttttagtaagtacttgataaatttgtatatgaatttgagtgccaatgtgtgccaatgtattcaagaaagagagggagaggtgaagtgagaagagaaaaagaaaaagtataggagaagataggagcccagctggggtcgttcctattgcagaggtggctttttggcacccgctaggtaactaagaatttgtgtatctagactatgcgagctttgtagtatgggaaactccattgttttggctacgaatttataaaggccaggattgctattggggaaaaaaaaaa

SEQ ID NO: 222 - DNA, 1146 bp, Eucalyptus grandis
gctcccctctctcgctctctctctctctctctctcggtctgtgtgaagactgaagttctgctcagtcttttgcaggggaagcaaagaatggccgtggttgggttgctgttggtgggttgcctcgcaatgtgggtgtgctccgtcgacgggtatggaggaggagggtggatcaatgctcatgccactttctacggaggcagtgacgcttctgggacaatgggtggagcctgcgggtatgggaacttgtacagccagggctacggcaccaacaccgcggcgctgagcacggccctcttcaacaacggcctgagctgcgggtcgtgctacgagatccggtgcgtgaacgaccgccagtggtgcctccctgcgagcatcgtggtcaccgccaccaacttctgcccgcccaacaacgctctccccagcaacgcgggcgggtggtgcaacccccctctccaacacttcgacctctctgagcccgtcttcgagcacattgcacggtaccgggctgggatcgtacccgtcgcataccggagggtgccctgccggaggaggggaggcataaggttcacgatcaacggccactcctacttcaacctggtcctcatcaccaacgtcggcggggccggcgacgtccatgctgtgtccgtgaaagggtccaggaccgggtggatgtccatgtcgaggaactggggccagaactggcagagcaacaactacctcaacggccagagcctctccttcaaggtcaccaccagcgacggtcgcagcgtcatgtcctacaacgcggcgcccgcccactggtccttcgggcagaccttctcgggagtccagttccgctagagaaaccaaaatattctacatgaaccggctagggagtttaataagatggtaacgcgatggaccacggactgcccagaaaccggcctatagacgaagatgtgtatatcgtggttagtatagagagtatcgattaaacccttgattgagatttgagtatgtatatgtgtgccacgtttgtaatatgcttggggcggaggtcattgtagcctcctagtcctagctcggtaccgagtcgatatgagaagaggctaataattttacataggctcctctcatgtttaggcattattttggttccgtgcggcc

SEQ ID NO: 223 - DNA, 2216 bp, Eucalyptus grandis
actctctcctcccctctctcgctctctctctctctctctcggtctgtgtgaagactgaagttctgctcagtcttttgcaggtaataatcaccccaaccccatttgggtcattgctctaactccaagaagcctctttcttttcgtctatacttatgctaggcttggagagtgcggtgtgcttgaaactggagtccttttttttacccaaaaatgctgcattgcataatttggttgatttggtctttggcatgcgcaggggaagcaaagaatggccgtggttgggttgctgttggtgggttgcctcgcaatgtgggtgtgctccgtcgacgggtatggaggaggagggtggatcaatgctcatgccactttctacggaggcagtgacgcttctgggacaatgggtaaccagcccttccccacttcgacgcctccctctcttcttcctcctccgcttcttcattttcaagctcttttgctctgttttgtctcgctagcactgtacacagctactcactctgctaatagtaacaatgataaaggtaacgacatccgacaggaacgtgtcgatgaagtccattgtcttccacgtttttcattgcggtcctactgtgctggtacatctgacgcagaaaagaaaagaaacaggggaaatttcaccgacacttgttaagcattctcacgctaagaaaaagatggtgaagtacagtactcaaattacattttcaggacatgaaagatggtgaagtacagtactcatacacatcattagaaaaagaagaggcaaaagacattgcttttttttttattttccacgtttcccagaatttgtaggttgacaggcatttttaagggaagtcgccagcacaacagaagggtcctctgcattttgctctcctataggtggagctcatctctaaactccgtctcatccttaaatttttggtcacattaggtggagcctgcgggtatgggaacttgtacagccagggctacggcaccaacaccgcggcgctgagcacggccctcttcaacaacggcctgagctgcgggtcgtgctacgagatccggtgcgtgaacgaccgccagtggtgcctccctgcgagcatcgtggtcaccgccaccaacttctgcccgcccaacaacgctctccccagcaacgcgggcgggtggtgcaacccccctctccaacacttcgacctctctgagcccgtcttcgagcacattgcacggtaccgggctgggatcgtacccgtcgcataccggaggtacgtgcattgcaacgctaggcccagtttttttggtcgcgtgaaaaagttaggcgcgtgtgttaagcacatgaactctttggtccgactagtcaatttacaatgtccagtgtgggggactttttgtagggtgccctgccggaggaggggaggcataaggttcacgatcaacggccactcctacttcaacctggtcctcatcaccaacgtcggcggggccggcgacgtccatgctgtgtccgtgaaagggtccaggaccgggtggatgtccatgtcgaggaactggggccagaactggcagagcaacaactacctcaacggccagagcctctccttcaaggtcaccaccagcgacggtcgcagcgtcatgtcctacaacgcggcgcccgcccactggtccttcgggcagaccttctcaggagcccagttccgctagagaaaccaaaatattctacatgaaccggctagggagtttaataagatggtaacgcaatggaccacggactgcccagaaaccggcctatagacgaagatgtgtatatcgtggttagtatagagagtatcaactaaaaacccttgattgagatttgagtatgtatatgtgtgccatgtttgtaatatgcttggggcggaggtcattgtagcctcctagtcctagctcggtaccgagtcgatatgagaagaggctaataattttacataggctcctctcatgtttaggcattattttggttccgtgcggtcccctgcatattttagtaattacagaagtgggcagtggtggagttctaccacccgcaactatgtagcttttcctatcattagtagtctttttgccgtgtccctctcggtgctcgagaaggtcatgtttctcccgcatttggctgtttatgtccacgactgtaatatgtttgtattggaaacatcaagtcattctattcaaaaaaaaaa

SEQ ID NO: 224 - DNA, 1117 bp, Eucalyptus grandis
acactgactcgacaacaataagaaccaagatggccttgcttctctgcttcctcctctctctcttcatctcatccgccactgcttgcgatcgctgcgtccaccagtccaaggccgcttacttcagcaaggcctctgcactttcgtctggagcatgtgggtatggctctttggctgtgggcttgaacagtggctttctcgcagcagccattccttccctttacaaagatggtgctggttgtggtgcttgctttcagataaggtgcaagaacgccaatctgtgcaccaaaggagggactagagtgatcgtgaccgatctcaaccgcaacaacaacacagacttcgtgctcagcagccgagctttcgcggccatggctcgccaggggatgagccaggacatcttgagacaaggcattgtcgacgtcgaatataaaagagtcccttgcgactacaaggaccggaatctggccgttcgggtggaggagtcgagccgaaagccaaattacctcgccatcaaagtgctgtaccaaggcggccagaccgaaatcgtggccatggacgtagcacaagtcggttcgtcatattggacctacatgagcaggaaccacggcgctgtttggaacacgagccgcgtccccgatggggcattgcagttccggttcgtggtgacccctggctacgatgggaagtggatctgggcgaagagcgtccttcccgcggattggcagaacggggtcgtctacgattcaggagtccaaattaccgacatcgcacaagagggttgctctcaatgtgacgacgggagctggtgatgaggagtttttggaccgacccttgatttgattatcgccgatactaacgtctatatagatgaattgtcatatagatcatgttcttgattttctttttccggtgatctatgcgatttcttctgcatatagcgaataaagagtaatggggtacgtataattggggaaggtgaaatgctggccaggggtatctgactcgggcgtaacatagataggaaaggttttcttaaagtatcagtgatacaaattgtactctggtgacatgttaatgagaatgttcggtaataagtttcataaaaaaaaaaaaaaaa

SEQ ID NO: 225 - DNA, 1190 bp, Eucalyptus grandis
ctgaccaaagtgtctcgagaatcacatggcgcttcttcaatctccatcgatttgcttccctctcgcccttctccttgctctcctcataaactcgtctcactgcttcaaccccaaatcgcttaacatctcgaaagttcagtccaacggtgattggtcgccggcaggtgcgacgtggtacgggagtccgaacggcgctggaagcgatggtggcgcatgtgggtatgggagtggggtcgaccaagctccattctcttcaatggtgtccgcaggagggccttctcttttcaaatcaggcaaaggatgtggagcttgttaccaggtgaaatgcactgaaaatgcggcttgttccgggaacccggtgacggtcgttataactgacgaatgccctggtggcccttgtgtcgctgaatctgctcacttcgatttgagcggcacggcttttggagccatggcgagctccggcaaggccgatgaacttcgcaacgctggggtgctgcaaattcaataccaaaaagtaaagtgcaatttccccggcgcgaaggtggcgttccacgttgactccggctcgaaccccaactatttcgctgcgctaattgagtacgaggatggggatggcgagctcggcgccgtcaacctgaagcaggctctagactctgactcttggcttccgatgcaacagtcgtggggcgcggtttggaagttggatggcgcaggccagctgcgcgctccattctcgatcaagctcacctctcttgactccggcaagaccctggttgccaacaacgtgatccccgctgggtggcagcccggacagacgtaccggtcggtcgtcaactttgctgtctaagggttgtgcgtggtttgcttgggagacgaagaaatggagattgatcgtcagttaatttggctctgtatgttttatgtgacaggcaaaattagaatattggatggtgtggaaaaagaaattattttgctttttccactctgtgtaatctagtcagctatgagctacctcttggaaaagagagtagtagtgagaaatgaatggtattgtcctttgaaaatcaagaatgatttaggtatttttgttccttttttcttgccaatctattgtatttgaagcttgaaagcttttatgttttgcaccaatatatgtaccacttccaaaatggatggttataaaaaaaaaa

SEQ ID NO: 226 - DNA, 634 bp, Eucalyptus grandis
ggcacgagggcaatggaggtgaaattgcaggtgctggtggcgttggccatggctttgtccttgttctctgctgcatcggccacggcgggcctcgccgtttactacgcaccccaatattatcccgcggcttgtccagggttcactctgaagaacagcggagtgatggtcgcgggagtgagcgatgcgttgtggaataacgggagggcctgcggacggatgctgaaggtcagatgcacccgtgcggctaaccagtttccgaacccttgcagggccggcgtcatcacggtcaaggtcgtggactactgccggcaaccgtgcaacggggtcatcaacctctcccaggacgcctttgcaaagatcgccaacctcgacgccggcaaagtctgggtggactattcctaggaaggacctcgaaccacttttcttgaaggaaaaacgtatatggatgataccgaagataatgtctgcttttgtggtttggctttgccgggtttgaagaccacttaaataacgcgatacttaatcgccgatatggtttgaataaaaatatgattgtgtgacgttaatacctcgttttggaatggtcttctgaataacaagaagttggcatcgagataaaaaaaaaaaaaaaaaa

SEQ ID NO: 227 - DNA, 1626 bp, Eucalyptus grandis
tggcaactgggagccttctactatctcagccgcttcacctccttcatctcctcctcttcctcctcctcctcctcctcgcctttatgctcccgaagaccatctccgtggccaccggtgacgacggcacagcttcatattatgtacctccttatgaacggacggagtgctacggtgagggctcatcgcagttccctgagagtaatttcttcgcggctgtgggtgacaatctctgggacctgggggcagcgtgcggcagggagtacgaagtgcggtgcatcagcaaggcgcagtctggccctggaccctgcaaacccggctccgacaccatccgggtcaaggtcgtcgattacgccctctcggttagctcctccgccgccgcccccaagcagtccgtaactggcgctgatttggtcctgtctcagatcgctttcgaagccattgccaatccgtccgtcgattccatcaccgtggagttgaaggaggtctgatttttggtgatggctcaaggcttgagacagagaggcgaaaggaaatcaacagatgataatgatatcaaataaattcagacatggtttatctggaatgctggttggttgtgttgctttttcgttttttcaaatgtttggtgttttcaaatttaagaggatgaactcggccggtctcttgagggttgaggggaaagatcggaggatacatcggccgcacttgatccttgcaaagatgttcactctgtcgctggttttaagtttctacaagagggaagccgtacctgatccgctttgccccccgtgtcgccaactgcccttggacgaaaggggtttggtctgatcagaggctccagcgaatggttcaattgctgtttgaatcgaagaatctcttaccgacaaaagaagagcttgctggaatcctatggtcaatctggaatgcccgatatgcctatatttttcgatcaagacagccgcaagctaccatggtcgtagatgaagcttgttcagcgcaaaaaaatcgactttaggtgtggaaccaagaggcagaatcgaaaattgagagagatggactcaacttgtgaaatggctcccaccagcgtatgtagtgttgaaattcatctcggatggctcgtgggtggaagggacgatagatggagctgttgctggagtgtgccggtatttgaatggtgttgtaacggacggtttcgtcaaatcaggtcgagcttcatcgttaattgaagatgaaaccctggctttgcatcaaacacttgagagggtgaagattctctttgatctacacagagagactgatttgcaggttgttgtggagggtgataactcatcactcgtgcgctacgtgatgggatctgagcagagcccatgggccatccgaccttggattgaagatcgcagattttggcgaggccaacttagaggtagaggtgtccgactagcccatcgtctcagagacgcgagtcaagtcgtggactggatcgtgaaggctcatcgcaagaagattctccttgtagttggcttgcgaaccctctgaatgctcttttatttttattttgttcggatgttgcacaaactttcctttagtgactaatgaattgcatatctttttcggccaaaaaaaaaa

SEQ ID NO: 228 - DNA, 1060 bp, Eucalyptus grandis
gccatgggcaaactgtattcactcaatcgggtcgagttttgatttccttccatacacggtcctctacttgctttctcttcttgttttggctccggttctgagggcgaaaagagatggttcctctaggattcctggtggtcggcttgctctcgcaattcgtgccggtttctcgcgcctatggatattacggcgggtggacgaatgctcatgccacattctatggagggagcgatgcttccggaacaatgggaggggcttgtgggtatgggaatctatacagccaagggtacggcacaaacacagctgcactgagcactgcattgttcaacaatgggctgagctgcggcgcgtgctttgagctccggtgcgtgaacgacccgcagtggtgcctcccgggcgccattgtggtcacggcgaccaacttctgccctccaggagggtggtgcgaccctcctcaactccatttcgacctctcccagccggtcttccagcacattgcgcagtacagggccgggatcgtcccggtggcctaccgaagagtgaggtgcaggagaagcggagggatccggttcaccgtcaacggccattcttatttcaacctcgtgctcataaccaatgtcggcggagccggggatgtgcactccgtggccatcaaaggatcaaggacccggtggcaacccatgtcgagaaactggggacagaactggcagagcaactccgacctcaatgggcagagcctctctttcctagtcaccgccagcgacggccggagcgtcgtgtcctacaacgtcgccccttctggttggtccttcggtcagacttataccggaggccaattccgatactaattatcgaacccgtgcttacaaccttttactagcacaagtcgtgaaaaacattataagtatgaaaatccaacttggatttctacgttgccgtcgcgctgatcgttccaaacagggcactaattcgatcggcaagttgaagttaaaaagactgaagtctctaaggaattgatgattgaatcataagtgctttttttgcttgctgaaaaaaaaaa

SEQ ID NO: 229 - DNA, 1552 bp, Eucalyptus grandis
aatttcttgagtggagagcttataccaagtgagaagagagaaacaccgaacatggcttccaaatcttcaacctcgccagcatttctcttttcaatgattttggctcttgtggttggcatcaacggcggaggaattgctatctattggggtcagaacggcaacgaaggcactttagccgaagcttgtgcctctggaaattacaagtttgtgaacctagctttccttaatgtcttcggcaacggccagactcctatgatcaacgtcgctggccactgcgatccttccagcggaggatgcaccggcttgagctctgagatcaagtcttgccaagctaggggagtcaaggtgatgctctcgatcggaggaggtgtggggagttactatctcccttccgccgaggatgctagatacgtcgcaacttatctgtgggacaacttcctgggaggccagtcctcatctcgaccgcttggggatgcagtgctcgacggcattgatttcgtcatcgcaacaggcacgaatcaacactgggatgatctggctaggtacttgtctgcatatagcatcagtggaaagaaggtgtacttggccgcagcccctcaatgtccttatccggatgcttgggttggaggtgcccttcaaacaggcttatacgactacgtctgggtccaattttacggcaatcctccatgcgaatacagttctgggaacatgggtaatctcgaagacgcatggaatcaatggacttcgattcccgctggagaaatcttcttgggattgcccgcgtctgcggatgctagtagtggttttattcctgcatcgaatcttacttccatagtactgcccaccattaaaggatctgccaaatatgggggtgtgatgttgtggtccagaactgtattccccagctcacgggcaagcgggcacgattcccacgtctatgctcgggacggattccccgattccccgattcgtcgattcccgattcgtcgattctccgtttcgattcagctgggttatgtgatgatagttgatggttcttcttctcagctgcttttgaagagaaggagactcgccatccccgaccccatggaagctgaacccgcaaaggtcctctctctctctctctctcactcgattttctccatgttgatgctgggtctgtgatggttcttcgtttactttcttgggtcggtgatggatcgaagctgcgattgtggcgcttcttgggtttttgctcgatcggtggtaattcgcttcacgaattgtcgatagcttatagtgagaagtaaagatggctttttttaggtgcattgccagtagagagggaaagagaatttgaggaagttgcccgctttagttcacgggggttgtttcgacctggctagatggtgggggttctgtattcgtgtgtacagggatgaatcaaagaaagggcatgatgggcgaacacgtcgtctgtctggttgtcgcattagacaatgcactgtcgatgctgtttgcttctgtatctaatcaccggtccgtgtccagtgtggtgatttgcgaaaaaaaa

SEQ ID NO: 230 - DNA, 1058 bp, Eucalyptus grandis
attaaaacagcgagaaatgccaagcccacctccatccaaaccgtccctctccctcctcttacttctcttcagctcgtcactcatccgagcctctcatggcggcgggattgccatttactggggccaaaacggcaacgaaggtaccctcgccagtacatgtgccaccggcaaatacgcctacgtaaacctcgcattcctctataagtttggcggtggccagaccccgcaaatcaacctcgcaggccactgtgaccccacctcgggtggctgcactagtacaagcaatggtattcggagctgccagaatcagggcatcaaggtgatgctctccctaggcggcggtgttgggagctactcgttggcatctcaggccgatgcgaggaacgtagcgaattatctgtggaacaatttcttgggcggcacatcaagttctcgtccgctaggagatgcagtcttggacggtatcgacttcgatatcgaacttgggtctaccaagtattgggatgatcttgcccgttatttatcagactatagcaagcaagggaaaaaggtgtacctaacggcagctcctcagtgcccatatcccgatagtcatatgggggctgcgcttaacaccggtcttttcgactacgtctgggtacagttttacaataaccctccatgtcaatacagctccggcgatattagcaagctcacaagttcttggagcaaatgggttgcttccataaacgccgggaagatgtttgtgggcctgccggcgtccacggaagcagcaggaagtgggtatgttccaccaaacgtcttgacttctcagatacttcctgtcataaagaagtcagcgaaatacggaggcataatgctgtggtcaaagtactatgatgataagaatggttacagcgactccgttaagagtagtgtatgagctggatctccatgcatgacaggagtacagtctcatctctagaattaaataaagctgttggcaagcggtatgtccaatacattaaggcttaggccattaagtaatgtgggactataatattctgagaaaaaaaaaa

SEQ ID NO: 231 - protein, 554 aa, Pinus radiata
MVSMDRRWIPLLLALLCLMSPLNALVSASESTFYESFDESFEGRWIVSQKEDYKGVWKYEKSKGHEDYGLLVSEVAKKYAIVRELPETIDPKDGSLVLQYEVRLQNGLECGGAYLKYLRPQEAGWKPAEFDNESPYSIMFGPDKCGATNKVHFIYKHKNPKSGEYVEHHLKYPPSIPSDKKTHVYSAILTPDNQVRILIDGEEKKKANLLSADDFEPALIPPKTIPDPEDKKPEDWDERAKIPDPDAEKPEDWDEDAPMEIEDLEAVKPEGWLDDEPEEVDDPEATKPDDWDDEEDGEWEAPKVSNPKCDEAPGCGEWTRPMKSNPDYKGKWYAPMIDNPNYKGIWKPQQIPNPEYFELEKPDLEPIAAIGIEIWTMQDGILFDNILITHDEKVAEEYRKNTWKAKFSNEKEEEDVDSPLPGELSGFQKKIFDVLYKIANIPFLEAYKLKIIDLIEQGEKKPNLTIGILVAVLVVLLTTIYKLLFGGKKQPVQKVELKSQPEQDASASENNKEDSDIAAENEKSDAAEKEKSGDENEIEGEDAAPRQRRVRRET

SEQ ID NO: 232 - protein, 428 aa, Pinus radiata
MAGRRSLLYAVFLLLFATLVSAEVFFEERFDDSWESRWVQSDWKKDESLAGDWVHTAGKWNGDPNDKGIQTHTDYRFFAISAAYPEFSNKDKTLVLQFSVKHEQKLDCGGGYVKLLSGEIDQKNFSGETPYSIMFGPDICGYSTKKVHTILSYKGKNHPIKKDVPCETDQLTHVYTFILRPDATYSILIDNTDKQSGSLYKDWDLLPPKTIKDPNAKKPEDWDDKEYIPDPEDKKPEGYDDIPKEIPDPDATKPEDWNDEEDGEWTAPTIANPEYKGPWKPKKIKNPNYKGKWKAPMIDNPDFKDDPELYVFPNLKYLGIELWQVKSGTLFDNILISDDPEYAKKLAEETWAKHKDAEKEAFDEAEKKKEEEEKEKESDDEEDTDEKEEKSDDEDADELDDEHKEADKKEHELDSEHKEEDKKEHDEL

SEQ ID NO: 233 - protein, 356 aa, Pinus radiata
MAPDLKLVFVLLLLSAMYCSGSLDVNGKSMDELSSSQGQLRLGLRKVLEKKATTVTNSDDVRPSELGNITPSTTPHSRYTYPITTPTPPTIITTPPAITTPTPVITTPTTPTTTPVLNPPTAPVTTTPTTPTTTTPAVSGTQSWCVARTNVPENSLQVALDYACGIGGADCKAVQQGGQCYQPITVAAHASYAFNSYYQKNSKAPGTCDFGGHAIITTTNPSYGSCTYASGSSTISTPPPATIITAPPPPATVGIVAAPPPPATIGIGAAPPPPFGTTPTTTTPGYNVSTPTGGITSPIGGGITSPTVGGITGGLGPSASTYNTTPSYGSAPSFFQDLPSSFILFLLSLVVAVILG

SEQ ID NO: 234 - protein, 424 aa, Pinus radiata
MGRAGLRTSLLCILIFLSGLALSNAQSKISSSTTGINYGQVADDLPSPELVVGLLQTNSINKVKLYSVNETVLKAFANTGIELIVGMGNENVGNMTDPTKATEWVNENIRAYLPATKITGIAVGNEVYTGTDTQLMANLVPAMKNIHSALVSIGADMNIKVTTPHSLAVLGNSFPPSAGSFASNVKSLMKPLLDLLSQIGSPFFINAYPYFAYKGDPSQISLAYVLFEPNTGVIDPNNNVHYNNMLYAQIDAVYSALSALGYANIEVTVSETGWPSKGDANEAGATLQNAQTYNGNLLQLLAQNQGTPLRPKLVLQAYLFALFNEDMKPGPASERNYGLFKPDGTAVYNLGLSGTLSTGSPSTGSTSTGSFTTGTPPPAAYPSTTDSSYSYYSSAKETYSVISFYNHLLLLGLSTFFVVPLFLP

SEQ ID NO: 235 - protein, 414 aa, Pinus radiata
MGASVMGSGDLRMFCLLALVLLSGLVLSNSASSTSSSATGINYGQVADNLPSPEVVVGLLQTRNINKVKIFSANETVLKAFANTGIELIVAIGNENVGNMTDPTKATEWVNENIQAYLPATKITCIAVGNEVYTGTDTQLMENLVPAMKNIHSALVSIGADTDIKISTPHSLGVLGNSYPPSAGSFTSDLTSLMKPLLDFLSQIDSPFFVNVYPFFAYKANPSQISLDYVLFRPNAGVVDPNNNISYNNMLYAQVDAVYSALSALGYPNLEVTVSETGWPSMGDADEAGATLQNAQTYNGNLLQLLAQNQGTPLRPKVVLQAYLFALFNEDMKTGPTSERNYGLYKPDGTAVYSLGSTGTLSTGSTRTVATASYPTAADGPSSSAKETYSVVSFYNHLQLLGLSTFFVFLLFRP

SEQ ID NO: 236 - protein, 374 aa, Pinus radiata
MVFGISCRMAMVFIVWALMAFLSVGLEDSKALAITGSTVGINYGQIADNLPPPAKVAELLKALKVTKVKLYDWNPAILKAFANSDVELVVGIGNGFVAGLMDTQAALSWVTQNIQPYLSSTKVTGFSVGNEVYTGDDAALKANLVPAMRSIHTALVSLGLDSAIKISTAHSLSVLTSSYPPSAGAFDPAIMQLLREHLDFLAVTGAPFWINAYPFFAYKDNAGKISLDYALLKPNPGTDDPNTHLHYDNMLYAMVDAVYSALGAMGYGNLEVRISETGWPSKGDADELGASIQNAATYNRNLLQRLLKNQGTPMKPNSALQAYIFALFNEDLKNGPTSERNYGLFKPDESMVYNIGLEGGLTVEFSAYASSAQI

SEQ ID NO: 237 - protein, 472 aa, Pinus radiata
MEIIVRVSAITILLPLFIHCIRCGESIGRSRTLVEHSPALGVNYGQMADNLPSPSGVAKLVQSTTISKLRIYGADPAILQAFANTGIGLLVGISNDQIPSLNQLAVAQNWVKSNIVPFVPATDIIGISVGNEVLFSGDRVLISQLLPALQNLHTALVEVSLDQQIKVSTPHSMAILSASAPPSAGRFSGSFDMKALLDFLQKIGAPFMINPYPYFAYKSDPTDRTLAYALFEPNQGSYDTNTGLKYTNMFDAQLDAVYSAMKYLGYTDIDIVVAETGWPSAGDPSETGASLQNAIAYNGNLIKHVTSMAGTPMMPNRSIEIYIFGLFNEDLKPGPTSERNFGLFKTDMTMAYDVGLLRSQSASPSPAAPRTGGPVVAPPTAKVWCIAKPGVDEKSLKQNLDYACGQGIDCKPIQQGGPCYLPNTMASHAAYAMNAYYQSAGRNSLNCDFAQTGTVTSKDPSYGGCVYSTVNS

SEQ ID NO: 238 - protein, 470 aa, Pinus radiata
MEMIVKATTITILLPVILCCIPCGESGSGGRSLAQRLPALGVDYGQTADNLPPPSAVAKLVQSTSISKLRLYGADPAILQAFANTGIGLVVGIGNDQIPSLNQLAVAQNWIKNNIVPFVPATDIIGISVGNEVLFSGDGSLISQLLPALQNLHTALVEVSLDQQIKVSTPHSLAILSTSVPPSAGRFNESFDMKSLLDFLQKIGAPLMINPYPYFAYKSNPTDQTLAYALFEPNPGFYDTNSGLTYTNMFDAQLDAVYSAMKYLGYPGVDIVVAETGWPAVGDPTETGVSLQNAIAYNGNLIKHVTSMTGTPLRPNRYIQTYIFALFNEDLKPGPTSERNYGLFKVDMTMAYDVGLLQSPSAAPSPPAPRTGGPVTTPPTGKVWCIAKPGAEEQTLEANLNYVCGQGIDCRPIQPGGPCYSPNTVAGHAAYAMNAYYQTAGRNNWNCDFAQTGTLTSTDPSYGACVYPTV

SEQ ID NO: 239 - protein, 349 aa, Pinus radiata
MAASKDQMKILLLGCVAIYCYSIIAGGDKIGVNNGMVGDNLPPADQVVALMKQNNIGKYRIFQGSPEVLPAFANSGIDVIVGIETNRLQEMSSSQDAADSWVKTNIVPFYPATNIKYIAVGNEVVKVKENVSYLLPAMKNIQTALQNANPQNKIKVSTTHASESVIGNALIPPSKGVFLDDVKDTMSSVLKFLSDNEAPFMANVYPFFSYVNENWRNISLEYALFKSTSPVMQDGDHSYINLFDAIVDTIISAMENLGYQDFPLIITESGWPSAGLNVATVDNAQAYNNNLIKHVLSNAGTPKRPGRSIETYIFAIFNENQKPGAETERHFGLFNPDKTPVYSVNFSPY

SEQ ID NO: 240 - protein, 448 aa, Pinus radiata
MEAKTRPTAELDLRRGMGFRWAFILLLSVASIQSTEGFSVTGTVGINYGQIANNLPPPSQVVELLQASNLTNVRIYDANPQILNALRNTSVEIVVSLGNEYVATMSARPDKARQWVKKNVAAYIPAGTNITGVLVGNEVYAGNDTVLKNNLMGALKNIHSALVSLGLDNTVKVSTAHSFDVFVSSFPPSSCAFSDKSVTYMKQLLDFLSATHAPFLVNVYPYFAYKGDPSNVPLDYALFRPSNGVVDSKTNLHYDNLFYAQIDAAYSALAALGYGKVEVRVSETGWPSKGDDDELGATPENAKTYNGNLLERLHKKEGTPLKPNVSVQAFIFALFNENLKSGPTSERNYGLFKPDGTETYDLGLKGLKRIVSSLPPPPTVATGNSSNSTPTTAITSLTAPSPSVSTGDGTNSSSDSSSAKGMHSLVFISFYLQILALSSFISVLILEH

SEQ ID NO: 241 - protein, 423 aa, Pinus radiata
MEAKTRPTAELDLRRGMGFRWAFILLLSVASIQSTEGFSVTGTVGINYGQIANNLPPPSQVVELLQASNLTNVRIYDANPQILNALRNTSVEIVVSLGNEYVATMSARPDKARQWVKKNVAAYIPAGTNITGVLVGNEVYAGNDTVLKNNLMGALKNIHSALVSLGLDNTVKVSTAHSFDVFVSSFPPSSCAFSDKSVTYMKQLLDFLSATHAPFLVNVYPYFAYKGDPSNVPLDYALFRPSNGVVDSKTNLHYDNLFYAQIDAAYSALAALGYGKVEVRVSETGWPSKGDDDELGATPENAKTYNGNLLERLHKKEGTPLKPNVSVQAFIFALFNENLKSGPTSERNYGLFKPDGTETYDLGLKGLKRIVSSLPPPPTVATGNSSNSTPTTAITSLTAPSPSVSTGDGTNSSSDSSSAKVVL

SEQ ID NO: 242 - protein, 476 aa, Pinus radiata
MPTPKPKIFWLLLLILGLTIHAYAEDYTIGVAYGQYGDNLPSVQESIDLIQRLKVGRVKIYSTNPVILKALSNTGIKVSVMVRNEDIAGLSASQSVADKWVNDNIVPFYPATEINIILVGNEILTDYSNKQTWYQLVPAMQSIWQALVNYNLDHINVGTPLAMDMLGSSVPISAFPPSAGTFRDDIAETVMKPMLEFLHRTNSYFFMDVYSYFPYLFDPEDISLEYANFGENDKKYTDPNGLVYTNMLDQQLDAVVAAMSKMGYDDIKLAIAETGWPNAGDISQLGANINYAALYNRRVIRRMVADPPLGTPRRPNQFIPTYIFLLYDEDKKSGPGTERHWGFVYPNGTLMYEIDLTGKLQDSDYGPLPPPPPPYKGKLWCVADPTADVYALPSAIDSACSQGDSTCDAIQPGEPCYEPNTVIDHASYAFNSNWQRSKNFYSGCDFNKTAKLVTEDPSHGNCIYEFVDCVQKSVLC

SEQ ID NO: 243 - protein, 485 aa, Pinus radiata
MGEKLGSRGLLILLAFVLCISFTAEAIGVNYGRMGDDLPPPSEVAKFLQTTIIDKVKLFDADPGVLQAFANTNIGVVVAVANDQIAALNKLPAAQDWVKKNVAPFVPATNIIAISVGNEILSTGDKVLISQLVPAMQNLHTALVGASLDKQIKVSTPHSLGILSASEPPSIGRFRRGYDRVILKPLLNFLRTTGAPFMINPYPYFGYTDKTLNYALFKPNQGVFDNNTGITYTNMFQAQLDAVYSAMKLLGFSDVDIVVAETGWPSVGDPDQTAVNVENALSYNGNLIKLVNTNAGTPLMPNKTFDTYIFSLFNEDLKPGPTAERNFGLFKPDMTMVYDVGLMKSESATPAPISTAPVTPATPAPISTAPVTPTTPAPISTAPVTPTTPAPVTGTDKSWCVAKPDADPNVLQDNIDYACGQGVDCSAIQAGGQCFTPNTVVAHATYAMNSYYQLTGRHSYDCDFAQTGFLTQEDPSYGTCVYPTI

SEQ ID NO: 244 - protein, 500 aa, Pinus radiata
MDGMHGSKVCRYSRMQRTVPMLCTLLVAALGHLVILSAAANSGVFPPFYTRALGINYGRVADNLPSPSSAVALIKNLQAGYVKIYDADPQVLSALSNTALQVTITVRNQDISNISSSPTVAEQWVQANVLPHYPATLITAIMVGNEVLSDYQNQATWLLLLPAMANIHASLLNHGLADSIKVTTSLAMDVLSSSYPPSEGTFRSDVASPVLQPLLDFANRTGSFLFLDIYPFFAWSANPANVSLDYATLSLDRNTAEFQDAGLSYSNMLDAQLDAVLAAMDRLGFPSVNVVIGETGWPTKGDDNQPGTNVPNATLYNQQLVQKALADPPRGTPRRPGAFIPTYIFSLFNEDQKPGPTTERNWGLFYPNGTPVYPIVLSNDAPVLSHISVPSQNNAPFPSTPPGPVAAVQWCVVSPVAVAQVDETSLQAALDYACGAGADCSLIEPGEPCYLPNTLVSHASYAFNSYWQKNKAAGATCDFNGSAVLSSSDPSVGDCVFDHM

SEQ ID NO: 245 - protein, 480 aa, Pinus radiata
MGLMWVMFVCSLVLHIAGANEPEASPQPNPGIGVNYGTEGNNLPSPKQVAKMLGKTIVNRVKIYNSEPSILQAFANTGIAVVVGLENEKVQRISESPTAGQAWVAQRIAPYYPSTLIILITVGNEVLTNSDGSLDSALVPAIQNIHSGLVALGLDDKIKVSTPHSMAILSSSFPPSASTFATSLLPIMKPLLKFLDDTGAPFMVNAYPYFAYRDNPKEVSLDYVLFGQSPGVSDPKGFTYNNMLDAQIDSIYSAMAALGHNDTIPVTVSETGWPSKGDPDDIGVNPDNARNYNTRVIKHVTSNAGTPMRPNRVIETFIFALFNENHKPGPTTERNFGLLNPDGSKVYDVDLSCGWCASPPPPYSPPASPPPSPISLFSGPPKGSRGGLGFAVYCIAKPSSDPSVLQESLDFSCGLGGADCASIRQGGPCYNPNTVHAHASYAMNSYYQIHGRNYWNCDFKSTGLVTFTDPSYGSCHYPQE

SEQ ID NO: 246 - protein, 388 aa, Pinus radiata
MAMEGPRSGLALIISNFIFFLLSGSARTGTASNATIGINYGQIADNLPSPQRVAGLLRSINIIKKVKLYDANREVLEAFANTGIEFVVGLSNEYVGNMTDQAAAVDWVKENVQGYLPGTNITCIAVGNEVFTSNNTLWMSNLVPAMQNIHSALVSLGLQDSVNVTTAHSSFVLATSYPPSAGAFKPELTAFLRPLLDFLSQTTSPFLINAYPYFAYKDNADQIPLDYVLFQPNAGTVDPGTNLHYSNMLHAQIDAVYSALSALGYSAMEIKVSETGWPSKGDSDEVGATPENARIYNGNLLQLLAQNQGTPMRPSVRLESYVFALFNEDQKPGKTSERNYGLFKSDGSPAYDVGLHGSLSGASANPILYSKVVVSSLCSLFLLFFLGL

SEQ ID NO: 247 - protein, 134 aa, Pinus radiata
MARISFKLRLQALFLLWLFTSCPLFAAGARHARILESQRDNPGQRLWCIAKPSAYESDLLVNINYACSQSGVDCSVLQNGNPCYYPNTPVSHAAVAMNLYFQHYGRNYWNCYFNNTGLVVLTDPSYGNCEYISQ

SEQ ID NO: 248 - protein, 418 aa, Pinus radiata
MGVSLMGRGSLGMSCLWALVLLSGLALSNALSSTSATTTGINYGQVADDLPPPELVVGLLQTSNIGRIKLYTVNATVLKAFANTGIELIVGVANDIIGNLTDSNSATEWVNENIQTYLPATKIIGIAVGNEVYTGTDTQLMANLVPAMQNIHSALVSIGADTDIIISTPHSLGVLATSYPPSAGSFQPGLESLLEQLLALLSQIGSPFFINAYPYFPYEAQPSQIPLDYVLLEPNASAVVDQNNNVVYKNMLYAQVDAVYSALSALGYPNIEVIVTETGWPSNGDADEAGATLQNAQTYNGNLLQLLAQNKGTPLRPNVVLQAYLFALFNEDMKPGPTSERNYGLFGPNGVEVYNVGLTGSLSIGNKKAVSVGSPTGSADTPYYNTASAKETCTDISFYNHLQVLALSSFLVLLLFLP

SEQ ID NO: 249 - protein, 505 aa, Pinus radiata
MGMLYWTMDKLLLLFWVLLLMLAQSPGLTRGSTVGVCYGREGDDLPTPDKVAQLVKSIALKNIIIYDSNVQVLQAFAHTGIELIIGIPNSDLLGFSQYQSTADTWVTNNLLPYYPATMIKYIAVGTEVTESTINVTSLVVPAMRNLQTALKKAGLDQKIKVSSTHALSILSRSFPPSAGAFDSKYAFFLSPLLQFLAQTQSPFMINVYPYYAYRDSPRKVSLDYALFRPNDGVIDQNTGLVYTNMFDAQLDALFFALEALNFRSLRVMVTETGWPSKGGSKEPAATPDNAATYNGNLVRHVINNTGTPSRPGQEIDTYVFALFNENRKPGLESERNWGLFYPDETKVYNVDISGTGLPYVATGGNLTSVDGTSWCVASPSAKESDLQKALDWACGSGNVDCSPIQPGQPCYEPDNLASHASYAFNSYYQKNGASSVACNFGGTGNITTINPSYESCVYTTSRNGLANTTSTLSSSGVDSIASFSWLIGWVTTLFLVHLLTILKWL

SEQ ID NO: 250 - protein, 477 aa, Pinus radiata
MTFLFWVLVIFVLVGWVQGLGVNWGTQASHPLPPDAVVEMLKDNGITKVKLFDADEHTMKALANSGIQVMVGIPNDQLQVMATSTKDAANWVETNVTEFNLDGGVDIGYVAVGNEPFLKAYNGTFIQYTFPALQNIQNALNKAGLKNIKATVPLNADVYQGDTPSEGQFRPDINDLMIQICQFLASNGAPFTVNIYPFLSLYTNENFPVDFAFFDGTGQPVIDGNIQYTNVFDAALDTLFWALKRAGFPDLPVLVGEVGWPTDGDKHANINFAQRFNQGLLKHIMNGRGTPLRPQNIETYLFSLVDEDAKSIAPGNFERHWGIFQYDGTPKYALDLSGQTQNTALVSAKGVKYLPRRWCVFNPSASPSVLTQLPDSITYACTHGDCTSLGFGSSCNSLDYQGNASYAFNSYYQVNNQQNGACGFSSLAIVTESDPSQGTCKFEIQIAVSAASNTMNSYLYSLISVAGAVAVVLLSVL

SEQ ID NO: 251 - protein, 600 aa, Pinus radiata
MNDKMPLYLLYVFYCLAIFVIPTEAGREWNSIGINYVRAGKNLLSPAEAVSLMKALKIGRVKLYDSDPEVLTALANSGLSVVIAVKNEEIPTVASSILNADEWVKQSVLAHYPATRINAITVGNEILTDYNNQDRWSKLVPAMQNIHSSLVRWNLNKRIKVTTTVAMDALNSSSAPSLARIRDDIAESVMKPLLRFMSNSKSFYFVNAYPYFAWAANANKVPVDYAIFGAAKEAVQDGGLKYTDMLSAQLDANLAAMEKLGYPHVKIAISETGWPASGGPGANVDLAATYNRRVVVRMLANPPLGTPRRPRTFVPTYLFALFDADNNKHGTTRNWGMLYPNGSQVYPVDMTDKLTDLEFESLKSIRPFPARPTPIRSSISRSSPLTGSYPSPVPSYYSGPPTLVNPPAASPSTDNIPFSSPIPSVHPNPHPTINVPPYSPSPISTSPPTFSPPIVNYPPHCMPYPPTTPITTPPFAPYPPSNPTVPYTPNPPSTTPYSPYPPSTPSTPSSQSLWCVAKPTVPNSVLQQAMNYACGAGADCKSIQPNGLCFSPDTMVAHASFAFNSYWQKNKGIGGTCDFGGTAMLITMDPSYEGCHFGLI

SEQ ID NO: 252 - protein, 343 aa, Pinus radiata
MAASNEQMKRIVIGLIAVFCCAIVTDGDKIGVNYGMQGDNLPPADQVVTLLNGHNIGKMKLFNPDGGALNAFANSGIDVIVGVSNNDLQAISSSQDSANGWVNDNIVRYSSTSIKYIAVGNEVLPSTQYVSYLVPAMNNIQTAIQNANLQNIKVSTPHAFNVIGVSSPPSHGAFSDDVKDTMSSILKFLSDNGAPFMANVYPYFSYAGDTTDIHLDYALFQPTATPVTDGDHSYKNLFDAMVDSIFSAMEALGYSNVPLIVTESGWPSAGADAATTENAQAYNNNLIQHVLSNSGTPKRPGTNIETYIFALFNEDQKTGDEIERHFGLFNPDQSPAYSVNFSP

SEQ ID NO: 253 - protein, 344 aa, Pinus radiata
MAASNEQMKRILIGFIAIFCCSIVTDGDKIGVNYGMLGDNLPPADQVVTLLNGNNIGKVKLFDPDGGALNAFANSGIDVIVGVSNSDLQAISSSQDSANGWVNDNIVPYSSTSIKYIAVGNEVLPSTQYVSYLVPAMNNIQTAIQNANLQNIKVSTPHAFSVIGNSYPPSKGAFSDDVKDTISSILKFLSDNGAPFMVNVYPYFSYVGDSNDIHLDYALFQPTATAVTDQDHSYSNLFDAMVDSVFSAMEALGYSNIPLIVTESGWPSAGADAATTENAQAYNNNLIQHVLSNAGTPKRPGTNIETYIFALFNEDQKTGDEIERHFGLFNPDQSPAYSVNFYPN

SEQ ID NO: 254 - protein, 338 aa, Pinus radiata
MAAMKITLIGCIAILCSILADAAQIGVNNGMVGNNLPHADEVVTLLKEHNIGKYRIFQGSPGVLKAFENSGIEVIVGIETNRLQQISSSQEAANGWVKDNIVPFYPATNIKYIAVGNEVFKSNENVQYLVPAMKNIQTALNMANLQNKIKVSTTHASESVIGNSYPPSKGAFTDEVKDTMRSVLQFLSDNEAPFMANVYPFFSYVNNWKNIKLDYALFQSKSPVVESYTNLFDAIVDTIISAMENLGYDNIPLIVTESGWPSGGNINVATIEYARTYNNNLIRHVLSNAGTPKRPGRSIETYIFALFNEDKPSQDDTERHYGLFYPNKSPVYAVNFSP

SEQ ID NO: 255 - protein, 375 aa, Pinus radiata
MAASKEQAKIILVGFIAIFWGSILTDGDKIGINYGIQGSDLPPADEAVSLMKKNNIGKARIFKAQKDALKALADSGIDVIVGVATEDLQGISSSQHSADAWVNDNIVAFYPATNIKYIAVGNLILCSPQYISYLLPAMTNIQIALQNANLQNSIKVSTTHNMSVIAGIDFPVSNGANGDNVKDTTRSLLNFLIAHNSAPSQGTFSDDVKDSMRSILEFLSYHGSPYMANVYPYFIFTGGSSGSMSLDYALFKPTSPLVDGVRRYTNLFDAMVDTIISAMENLGYPDVPLIVTESGWPSFGEDVATVENAQTYNNNLIKHVLSNAGTPKRPGTSIETYIFALFRENLKSGPTTEHDFGLFNRDQTPAYTVNFSPLL

SEQ ID NO: 256 - protein, 372 aa, Pinus radiata
MAASTEQAKIILVGFIAIFWGSILTDGDKIGVNYGIQGSNLPPADEAVSLMKKNNIGKCRILKANRDELKALANSGIDVIVGVGTEELQAISSSQDSADAWVNDNIVAFYPATNIKYIAVGNLILCSPQYISYLLPAMTNIQTALQNANLQNSIKVSTTHNMSVIAGIDFPVSNGANGDNVKGTTRSLLNFLIAHNSAHSQGTFSDDVKDSMRSILEFLSYHGSPYMANVYPYFIFTGSSGSISLDYALFKPTSPLVDGVRRYTNLFDAMVDTIISAMENLGYPDVPLIVTESGWPSFGEDVATVENAQTYNNNLIKHVLSNEGTPKRPGTSIETYIFALFRENLKSGPTTEQDFGLFNRDQTPAYTLNFSP

SEQ ID NO: 257 - protein, 483 aa, Pinus radiata
MERQWFAILIICALGSMVCAVEGLGVNWGTMALHQLPPDIVVQMLKDNGIKKVKLFDADSNTLQALANTDIEVMVAIPNNMLQRFSDSYKAAEKWVDKNVTRYNFSGGVNIKYVAVGNEPFLSAYNGSYLNNTFPALQNIHKALVKAGLADQIKVTVPLNADVYNSPTDNAVPSAGDFRADIHDLMSEIVTFLNDNGSPFTVNIYPFLSLYADENFPTDFAYFDGDSQPLVDGNIQYTNVFDANLDTLVWSLKKAGVPNMTIIVGEVGWPTDGDKHATAAAAQRFNQGLLKHITSNQGTPMRPGNIEAYLFGLLDEDAKSVAPGNFERHWGIFGYDGQPKYELDLSGPLQNGGLVPAKNVQYLPPKWCVFKTNATDQSKILDSIKYACTYSDCTAMGYGSSCNNLDLYGNASYAFNMYFQVMNQYEINCDFTGLAMITEQNASQGTCKFPIGIAYGAAERSIKIHSILAAVLLGVVTFILSFL

SEQ ID NO: 258 - protein, 208 aa, Pinus radiata
MATSAMAVALHALVLLLLFGISFCSGPGKQKLYSSSRGNDTNLAAEEASFFLGNDSSTTTPSTPVTAGTTWCVAKNNVDDNTLQVALDYACGLGGADCTPIQQGGVCFDPDNVQAHASYAFNNYYVKNGMLPGSCDFGGSAAPTTLNPSYGKCTFETSTGTSSITSSPGSSITGAMGPSTFNPNGAAFMAPSLVISSIITILYFSATL

SEQ ID NO: 259 - protein, 472 aa, Pinus radiata
MEIIVRVSAITILLPLFIHCIRCGESIGRSRTLVEHSPALGVNYGQMADNLPSPSGVAKLVQSTTISKLRIYGADPAILQAFANTGIGLLVGISNDQIPSLNQLAVAQNWVKSNIVPFVPATDIIGISVGNEVLFSGDRVLISQLLPALQNLHTALVEVSLDQQIKVSTPHSMAILSASAPPSAGRFSGSFDMKALVDFLQKTGAPFMINPYPYFAYKSDPTDRTLAYALFEPNQGSYDTNTGLKYTNMFDAQLDAVYSAMKYLGYTDIDIVVAETGWPSAGDPSETGASLQNAIAYNGNLIKHVTSMAGTPMMPNRSIEIYIFGLFNEDLKPGPTSERNFGLFKTDMTMAYDVGLLRSQSASPSPAAPRTGGPVVAPPTAKVWCIAKPGVDEKSLKQNLDYACGQGIDCKPIQQGGPCYLPNTMASHAAYAMNAYYQSAGRNSLNCDFAQTGTVTSKDPSYGGCVYSTVNS

SEQ ID NO: 260 - protein, 316 aa, Pinus radiata
MHFTTAALVSALAATPVVYGQLDSKFKAKGKKYFGTCSDSGLLSVSQNANIIKSDFGALTPENSAKWDSIEPSRNGFNFGGFDTLVNFAQSNGKLVRGHTFVWHSQLPSWVSSIGDAATLTTVIQNHITTIATRYKGKIYGWDVVNEIFNEDGSLRSSIFSQRLGENFVSIAFKAARAADSNAKLYINDYNLDSVNSKVNGLVALVNRQKSAGTPIDGIGSQTHLSAGGSGGVQAAIQKLATTGCDVAITELDIASAPTSDYVAVVKACLNTPKCVGITVWGISDKDSWRTGANPLLFDSNYQKKAAYNSIISALA

SEQ ID NO: 261 - protein, 769 aa, Pinus radiata
MENFVLVLFCIGIGVFFNGGSLVQSAGSFPCDPSTGLSSFPFCNTSLPIGDRVKDLVGRLTLQEKVEQLVDQTTAIPRLGIPVYLWWSEALHGVSNVGHGTKFGGSIPGATSFPQVILTAASFNTSLWKEIGQVVSTEARAMYNAGQAGLTFWSPNVNIFRDPRWGRGQETPGEDPLVASLYATNYVQGLQETNGADTNRLKVAACCKHYTAYDVDNWNGFQRYTFDAIVSQQDLEDTYDVPFKSCVLNGNVASVMCSYNKVNGVPTCADKNLLAGTIRGNWSLNGYIVSDCDSVSVYYNQQHYGATPEDAAADAINAGLDLDCGSFLGQHTEAAVNESKVTESAVDQALINTFTVLMRLGRFDGDPAQQPYGNLGPNDVCTNENQQLALEAAREGIVLLKNDGSLPLAAKNISSLAVIGPNANVTKTMIGNYAGIPCKYTTPFQGLSAYTQTLYAPGCANVACISNDSLIAEAVQTASSADATVLIVGGDLSLEAESLDRTSLLLPGQQQQLVTQVADASKGPVILVIMSGGPFDISFAKNSDKISGILWVGYPGQAGGAAIADVIFGEYNPGGRLPVTWYPEEFSINVNMTNMTMRADPATGYPGRTYRFYTGQTVFEFGYGMSYTSFNITVVHAPELISVPLDEKYTCSPTQSESCETISLTNTKCDNMSLQVDVDVNNIGNRDGSHVLFLFSTAPSNNVDAPNKQLIDFKKVYVEAGATERVIFTPDVCKDLSIVDKTGTRMLPVGSRLLYIGDLEHSVSLQISS

SEQ ID NO: 262 - protein, 766 aa, Pinus radiata
MGLMENLVFVFVFCIVVFLKEGSLAQSVGNFPCSGQSSFPFCSTSLPIGDRVKDLVGRLTLPEKVQQLVNTASAIPRLGIPKYEWWSEALHGVSNLGPGTRFGGSVPGATSFPQVIGTAASFNTSLWQAIGQVVSTEARAMYNAGLAGLTYWSPNVNIFRDPRWGRGQETPGEDPVLASKYASNYVRGLQDTDGGDPNRLKVAACCKHYTAYDVDNWSGVQRYTFNAIVTQQDLEDTYNPPFQSCVADGNVASVMCSYNKVNGIPTCADKNLLAGTIRGKWNLNGYIVSDCDSVKVLFESQHYTPTPEDAAADAILAGLDLNCGDFLGLHTEAAVKAGKLPESAVDAALVNIFTVLMRLGWFDGDPTKQPYGNLGPKDVCTAEHQQLALEAARQGIVLLKNDGPLPLAANKVHSLAVIGPNANVTKTMIGNYAGIPCKYTTPLQGLSAYTRTLYAAGCADVLCSGNNLLGAAVQTAGNADATVLIVGGDQTLEKESLDRMDLLLPGQQQQLISQVAAASKGPVILVIMSGGPFDISFAKDNNKISGILWVGYPGQAGGAAIADVIFGAYNPGGRLPVTWYPQDFAAKIPMTNMNMRPDPATGYPGRTYRFYTGKTVYMFGDGLSYTNFKHTLVHAPKLISLPMDGKHSCSHKSSNSCEAIRVTHTKCQNLFLEVHVEVSNVGRREGGHVLFLFSSPPSKHHAPKKQLLGFRKLHLQAGAMEKVHFTLNVCKDLSIVDKTGTRKLPVGSHLLHIGDVQHSVSLQISS

SEQ ID NO: 263 - protein, 780 aa, Pinus radiata
MKSLWWLVNIVMMMVLGAIAEEPPFACDSRNPATRSYAFCDSSKPITVRVEDLISRLSLVEKVEQLTNNASAVQRLGIPKYEWWSEALHGVSQWGRGIHFNGPIHTATSFPQVILTAASFDVKLWYHIAQAIGIEARAIYNAGQASGLTFWTPNINIFRDPRWGRGQETPGEDPLLSSRYSVAYVRGLQGDPLSSSSKTNVRSSTHLRASACCKHFTAYDMDNWEGHTRFSFDAMVTKQDLLDTYQPPFKSCVELGRASGIMCSYNSVNGVPTCGDFNLLTSTARRDWGFQGYITADCDAVATIYTSHRYTPTAEDAVADVLKAGMDVDCGNYLGKYTMSAIAKRKVNESDIDRALRNLFSVRMRLGLFDGDLNHQLEGKLKMRVVCSAEHQRLALQAARQGIVLLKNSRKHLPLSKTRTKSLAVIGPNANNATTLLGNYYGLPCHTITPLQGLQRYVRDTLYYSGCEDLACISNNLFGEAVEIAKKVDEVVVVVGLDQTQEKEERDRIKLTLPGQQEKLVYQVSHAAKRPVVLVILSGGPVDVSFAVNDPQISSIIWAGYPGQAGGQALAEIIFGDYNPGGRLPVTWYPQDFVKIPMTDMNMRPNHHTGYPGRTYRFYTGKKVFDFGQGLSYSAYSYEFSSTTIKKIDLNVTMEHVETLGDTGKAHVRVENSPCRKLKFRCSILVRNHDNMDGRHAVLLYSKSPATHKGAPQKQLIGFRSVHVPGKQTTNITFVVKPCDHFSTVEENGQRLLAIGSHSLIVGDTQYSVSLVTKHSNRNP

SEQ ID NO: 264 - protein, 770 aa, Pinus radiata
MGPLAIAIADLLLWMLFLCCGIHGQPMFPCDSRIPNAANYPFCRTTLPIKDRVNDLIGRLTLKEKAQHLVSRSGAVSRLGIPVYEWWSEALHGVSNVGPGTHFDPRSVPAATSFPQVILTAASFNTALWEVIGQAVSTEARAMYNAGLAGLTYWSPNVNIFRDPRWGRGQETPGEDPLLSSKYATYYVRGLQSPDGRNPNRLKVAACCKHYTAYDLDNWNGVDRFHFDAKVSQQDLEDTYNPPFKSCVIDGHVASVMCSYNKINGVPSCADPKLLNGVIRGEWGLNGYIASDCDSVDVLYNTQHWTSTPERAVADVINAGLDIDCGTFLGDHAEAAVRVGKLRESLIDEALSHSLTVQMRLGLFDGNPAMQHYGNLGPRDICTNQHQQLALEAARQGIVLLKNNNRVLPLSATRIRSLAVIGPNADATNAMIGNYAGIPCRYSTPLHALGKYTATIYKPGCENVACNRNLPLIHAAAQAASRADATVIIVGADQSIEAEALDRVNLLLPGEQQQMVIETAAFSRGPVILVVMSGGPMDISFAKYNSKISSILWVGYPGEAGGDALADIIYGHHNPGGRLPVTWYPQDFVAKAPMTNMNMRPDRATGYPGRTYRFYTGRTVYPFGYGLSYTTFSHTLVNAPELVSLSLHDSPLMPYNGTNNSCTSVHVENTKCQGLLFDIHMDVHNTGNRDGGHAVLLFFSPPTIHRSPQKSLMDFRKVHVGAGATERVQFSIDVCKDLSIVDEIGVKKLALGSHILHVGDVQHSLNLQIE

SEQ ID NO: 265 - protein, 771 aa, Pinus radiata
MGPKAISNIAGLILWMLFLCCGIHGQPNFPCDSRIPNAASYPFCKTSLPIRARVSDLIGRLTLKEKVQQLVSKSAGVPRLGIPSYEWWSEALHGVSNIGPGTQFAAGSVPAATSFPQVILTAASFNTSLWEAIGQAVSTEARAMYNAGLAGLTYWSPNVNIFRDPRWGRGQETPGEDPLVVGRYGTYYVRGLQSTGGKNRNRLKVAACCKHYTAYDLDNWNGFDRFHFDAKVTQQDLEDTYNPPFKSCVMDGHVASVMCSYNKVNGVPTCADPKLLNGIIRGQWKLNGYIASDCDSADVLYNTQHWTTTPERAVADVLGAGLDVNCGTFLGDHAEAAVKVGKVKEALINRALINSFTVRMRLGVFDGNPATQPFGNLGPRDVCSEQHQQLALEAAREGIVLLKNNNRVLPLFKTRTRTLAVIGPNADVTNVMIGNYAGIPCRYTTPRQGLGKYATTIYKPGCQNVACQRNPTLIHDASQAASQADATVIIVGADQSVEREGLDRGSLLLPGQQEQMVLEVTAASRGPVILVVMSGGPMDISFARDSNKISSILWVGYPGQAGGDALADIIFGHHNPGGRLPVTWYPQDFVTRVPMTNMNMRPDRATGYPGRTYRFYTGKAVYPFGYGLSYTTFSHSLVHAPEMVSLSLHENQLLSCHGTNNSCNSVNVENTKCEGLLLDVHLDVQNTGSRDGGHAVLLFSSPPAVHGAPQKNMVGFRKVHVGAGTTERVHFSIDVCKDLSIADESGAKKLLLGSHLLHAGDVQHSLNLQIE

SEQ ID NO: 266 - protein, 801 aa, Pinus radiata
MRLLTVMSRQIQALCISIVLSLSIVIVISDSTDYACKEHDVNSVSYGFCNTSLPIKERVEDLIRRMTLEEKVGQLSNGASDVQRLGIPRYEWWSESLHGIATNGPGVNFDGPITAATVFPQIILSAASFNSTLWFRTAQAIAVEARAMYNVGQAGLTFWAPNINIFRDPRWGRGQETPGEDPLLTSEFAVAFVRGFQGENESHDTMEKSQRSRARRELKMEGLNSLQTEPSRLMLSACCKHFTAYDLDSWQGHARYTFNAVVSEQDLKDTFQPPFQRCVQDGHASCMMCSYNQLNGVPVCANYDLLTQMTRNDWGLEGYITSDCDAVAIISEDQHYATCAEDAVTDVLKAGMDINCGTYLLRNTMSAIKQGKLHESVIDQSLFNLFSIRMRLGLFDGDPKQQEYGHLGPDHVCTNEHWQLALEGSRQGIVLLKNIGNALPVSKNKINSIAVIGPNANATEEMLGDYIGIPCNPVTPFVALQNYIGNVSFSKGCENVACSSNAKFGEAVDIAAKADAVVIVVGLDLTQETEDHDRVNLTLPGQQQRLVSEVAVASKGPVVLVLMCGGPVDVSFAKDDPRISSILWVGYPGEAGGQALAEIIFGDYNPGGRLPMTWYPQKFINVPMTDMNMRPNSSTGYPGRTYRFYTGETVFQFGEGLSYSNYSYKFSSKDGHIILPFSSPSYGEWVSDYIDIDDIPCESFKFTTKLTVQNHGSMDGSHVVLLFSRYGGNFRGAPHEQLIDFKRVHIVAGKTTDVSFLVNPCKHFGMVMEDGRRVLAIGNHELMVGDTRLSVSLKTSFLSRK

SEQ ID NO: 267 - protein, 770 aa, Pinus radiata
MGASAVPIAGLILWILFFRCGIHGELMFACDSRIPNAANYPFCSTALPIKDRVNDLIGRLTLEEKIQQLVSKAAGVPRLGIPGYDWWSEALHGVSNVGPGTQFAAGSVPAATSFPQVILTAASFNISLWDAIGQAVSTEARAMYNTGLAGLTYWSPNVNIFRDPRWGRGQETPGEDPLLVSQYAANYVRGLQLTDSLDTNRLKVAACCKHYTAYDLDNWNGADRFHFDAQVTQQDLEDTYNPPFKNCVIDGQAASVMCSYNKVNGVPTCADPKLLNGVIRGEWGLNGYIVSDCDSAEVMYNTQHWTSTPERAVADIMESGLDVNCGNFLADHGEAAVKVGKLKETFIDTALFNSFTVQMRLGLFDGNPAFQPYGNLGPGDVCSEQHQQLALEAARQGIVLLKNNNGALPLSPTQIRSLAVVGPNADVTNVMIGNYAGIPCRYTTPLQGLGKYTATIHKLGCENVACQSNSILLSEASEAATQADATVIIVGADQTVEAEMLDRVSLSLPGQQEQLVLDTADAARGTVILVVMSGGPMDISFARDNPKICGILWVGYPGQAGGDALADILFGQHNPGGRLPVTWYPEEFAIKVPMTNMNMRPDPATGYPGRTYRFYTGNSVYPFGYGLSYTTFSHSLVRAPKLVSLSLHESLLKSCRGMNNSCASVEVENTKCQGLLFDLHAEVHNTGSRDGDHVLLLFASPPAIQGIPQKRLMGFRKVHVGAGGTERVHFSIDVCKDMSIVDGNGVKQLLLGSHLLHVGDTKHTLRVEIE

SEQ ID NO: 268 - protein, 537 aa, Pinus radiata
MGHICSCKWQFLILLCFVFFPFAAPTEGRRLAQTPKVRGVNLGGWLVVEGWIKPSLFDDIKDNDLLDGTKVQFKSAKLNTYVSAENGGGQNAVVNRDNASTWETFKMWRVSDGMYQLRVFSGQFLTAENGGGGNMSAEADSPADWETFHIIRHHKHPNRVHIRVFNGMYMQAQSQEQLTADYQGDPGWHDNSATFQMIIVANDLHGDYQLANGYGRDKAKKVYHRHRSSFITDKDFKFLSRNGINTVRIPVGWWIAYDPNPPAPFVGGSLQSLDNAFKWADHYGLQVIVDLHAAPGSQNGMEHSASRDGSADWSNSSDHISQSLTVIDFLASRYSNNSMLLGIELLNEPLATTVPVDVLASYYSNGYQTVRKYSATTYVIMCQRIGNADPHELYQINDAFSNIVVDVHYYNLFDDYFDNKTAQDNIDFISKNREPQVEALNSTNGPLIFVGEWTNEWKVQGASRSEYQQFGDAQLQAYEKASFGWSYWTLKNEEKHWDFEWNIKHNYLRLGNSRATSNKSISWRIYAFLLIFGCIYV

SEQ ID NO: 269 - protein, 622 aa, Pinus radiata
MVSRMNSGWYVFLCVVILCKCAGAIGYARYKDPSQPIDARVKDLLSRMTLEEKIGQMTQIERTDATADVMKHYYIGSVLSGGGSVPAPKASPATWINMVDELQKGAMSTRLQIPMIYGIDAVHGHNNVYGATIFPHNIGLGATRDPDLARRIGAATALEVRATGIQYTFAPCVAVCRDPRWGRCYESYSEDPKIVKAMTEIIVGLQGNPPANSTKGGPFIAGQSNVAACAKHFVGDGGTTKGIDENNTVINYQGLFNIHMTPYFDAIAKGVSTIMVSYSSWNGQKMHANHFLVSQVLKKQLGFKGFVISDWQGIDRITSPPDANYSLSVLDGVGAGIDMVMVPDNFTDFISDLTSQVKGGFISMSRINDAVQRILRVKFTMGLFEHPMADPSLANQLGSKEHRELAREAVRKSLVLLKNGKSASKPLLPLDKNAPKILVAGTHPDNLGYQCGGWTIEWQGLSGNSTIGTTILEAIKFAVSPSTDVVYQQNPDANYVKGQGFSYAIVVVGEAPYAEMKGDNFNLTIPLGGGDTIKNVCGSLKCLVILISGRPLVIEPYLPLVDAFVAAWLPGTEGQGVTDVIFGDHGFQGKLPRTWFKSVDQLPMNVGDKHYDPLFPLGFGLT

SEQ ID NO: 270 - protein, 632 aa, Pinus radiata
MDSIWCLFLFLVAFGKCADAAQYTLYKDPSQPVSARVDDLLARMSLEEKIGQMTQTERSVATPDVMTNYYIGSVLSGGGSAPAPQASPATWMNMVDGLQKGAMATRLQIPMIYGIDAVHGHNNVYGATIFPHNVGLGATRDPDLVKRIGAATALEIRSTGIQYTFAPCVAVCRDPRWGRCYESYSEDPTIVKAMTEIIYGLQGQPPANSTKGVPYVAGQSNVAACAKHFVGDGGTTQGVDESNTVTDYKQLVNIHMTPYFDAIAKGVSTIMVSYSSWNGHKMHANRFLISHVLKKQLSFKGFVISDWQGIDRITSPPNANYSLSVLESVGAGIDMVMVPFNFADFINDLTSQVKGGFIPMSRINDAVQRILTVKFTMGLFEHPMGDPSLANQLGSKEHRDLAREAVRKSLVLLKNGKSASQPLLPLNKNAPKILVAGTHPDNIGYQCGGWTIEWQGLSGNITIGTTILSAIQSAVSSSTEVVYQQNPDANYVKEQGFSYAIVVVGEPPYTEMFGDNLNLTIPLGGGDTINNVCGSLKCLVILISGRPLVIEPYLPLVDAFVAAWLPGTEGQGVTDVIFGDYSSQGKLSRTWFKSADQLPMNAGDQHYDPQFPLGFGLTTTVAENISSSFGVL

SEQ ID NO: 271 - protein, 629 aa, Pinus radiata
MANRMDSGWCLLLFVVVLCRCAEAVEYAKYKDSSQPIDARVDDLLARMTLEEKIGQMTQIERTVATADVMKNYYIGSVLSGGGSEPAPQASPATWINMVDGLQKSALSTRLQIPMIYGIDAVHGHNNVYGATIFPHNIGLGATRDPDLVRRIGAATALEVRATGIPYTFAPCVAVCRDPRWGRCYESYSEDPTVVKSMTQIILGLQGQPPAKYKRGIPFVAGESNTVACAKHFVGDGGTTDGINENNTVISYDGLVNIHMAPYFDAIAKGVSTIMISYSSWNGVKMHANRFLVSQVLKKQLGFKGFVISDWQGIDRITSPAGANYSLSVFDGVSAGIDMVMVPYNFMDFIGDLTSQVKSGLISMTRINDAVRRILRVKFTMGLFEHPMANPSLANQLGSKAHRELAREAVRKSLVLLKNGKSDSKPLVPLDKNATKILVAGTHPDNLGYQCGGWTITWQGLSGNTTKGTTILEAIQSAVSPSTEVVYQENPDANYVKGQGFSYAIVVVGEAPYAETAGDNLNLTIPLGGGDTINNVCGSVKCLVILVSGRPLVITPYLPLVEAFVAAWLPGSEGQGVTDVIFGDYGFQGKLSRTWFKSVDQLPMNVGDKHYDPLFPFGFGLTTTVAKNL

SEQ ID NO: 272 - protein, 618 aa, Pinus radiata
MDSGWYLLLFVVVLCRCAEATEYAKYKDPSQSITARVDDLLARMTLEEKIGQMTQIERTVATADVMKNYYIGSVLSGGGSAPAPKASPATWMNMVDELQKGAMSTRLQIPMIYGIDAVHGHNNVYGATIFPHNVGLGATRDPDLARRIGVATALEVRATGIQYAFAPCIAVCRDPRWGRCYESYSEDPKIVKTMTEIIFGLQGQPPANSTKGVPFLAGQSNVAACAKHFVGDGGTTEGINENNTVISYKGLVHIHMAAYFDAIAKGVSTVMVSYSSWNGGKMHANRFLVSRVLKKQLGFKGFVISDWQGIDRITSPAGANYSLSVFDGVSAGIDMVMIPYNFKDFINDLSSQVKSGLIPMTRINDAVRRILRVKFTMGLFEHPLGNPSLANQLGSKEHRELAREAVRKSLVLLKNGKSANKPLLPLEKNASKVLVAGTHPDNLGYQCGGWTMEWQGLSGNITVGTTILEAIKLAVSPSTEVVYEQNPDANYVKGQGFSYAIVVVGEAPYAETFGDNLNLTIPLGGGDTIKTVCGSLKCLVILISGRPLVIEPYLPLVDAFVAAWLPGTEGQGVTDVIFGDYRFQGKLARTWFKSVDQLPMNIGDQHYDPLFPLGFGLV

SEQ ID NO: 273 - protein, 528 aa, Pinus radiata
MAACINIHARNCPQGCFKFVILVLITSCLAYGSEASEVRRLTIGTQKYHSVALGGWLVIEGWIKPSLFDGIPDNDLLDGTQIQLKSMKLGTYIVAENGGGQKVAVNRTNPLKWETFRIWRVRDGYYQLRVFNKQFLGADNGGGGVVKAVATTPRSWETFQIIRNNADRNRVHLKALNGMYLQANSKDQLTADFKGEPAWDGNNAATFEMSFTGHMQGEFQISNGYGPERAAQVLKEHRSTFIREDDFVFLSKQGISAVRIPVGWWIASDPKPPAPFVGGSLECLDKAFSWAQNHGIKVIIDLHAAPGSQNGDEHGGGRDGYIEWADSQKNIDTTLSTIDFLASRYAAHPALLGIELLNEPRSSGISLNNLTAYYTQGYNIVRKYSSSAYVIMCNRIGPVDPKELFQINNGLFRTVVDVHYYNLFDDSTFKHMTVQQNIDYIKNTRAQTLQSLVSANGPLIFVGEWVAEWEVQNATQSDYERYGDAQFQVYGTASFGWTYWTLRNIGNRHWDFQWMVNNQYLRLPSIQI

SEQ ID NO: 274 - protein, 530 aa, Pinus radiata
MAAYIDVHAKKLSQRCFGFVITLLVFTSSLAYGRKILEARRLTNDTQKYHSVNLGGWLVIEGWIKPSLFDGIPDKDLLDGTQIQLKSMKLGTYVVAEDGGGTIMAVNRTNPSGWETFSLWRARDGYYQFRVFNKQFVGADNGGGGIVEAVATTPNSSETFQIIRNPANSNSVHIKVFNGMYMQAQSKDQLTADFEGEPGWDDNNAATFEMTIVRTLQGEFQISNGYGPEKATQVLNEHRSTFITEDDFVFMSKNGISAVRIPVGWWIASDPYPPAPFVGGSLACLDKAFSWAQNHDIKVIIDLHAAPGSQNGDEHSGTRDGFIEWPESQENIDKSLSVIDFLAARYAAHPALLGIELLNEPRSPAVSLNNVTDYYSRGYDIVRKYSSSAYVIMCNRIGPADPKELFQMNNGLSRTVVDVHYYNLYDDATFKNMTVQQNIDYIKTTRAQTLQSLVSANGPLIFVGEWVDEWELNSATQSDYQRYGDAQLQVYGEASFGWAYWTLRNIGSRHWDLEWMVQNQYLLLPASNQS

SEQ ID NO: 275 - protein, 468 aa, Pinus radiata
MGFIHTMAIPESKVFWLLLAIVGGVIHAYAEDYTIGIDYGQLGDNLPSTEEAIHLIQRMKVGRVKIYDTNPEILKALAHTGIKVSVMVKNEVIANVSANQSFADKWVKNNVVYFYPATKINIVLVGNEILSDYSNNQTWYQLVPAMLRIRRALVRYKLHHIKVGTPSAMDVLNTSFPPSSGAFRDDVAETVMKPMLEFLTRTRSYFFIDVYPYFAWSSDPTNISLEYASFGDHDKNYTDPNGLVYTNLLDQQLDAVVAAMSKLGYEDIRLIIAETGWPNAGDLNQLGANIFNSAHYNRRLIRRMLADPPLGTPRRPNQFIPTYIFSLFNEDQKSGPGTERHWGLLYPNGTRVYEIDLTGELQDSEYKPLPPPPPPYTGKLWCVVDANANVSSLPSAINYACSQGNNTCASIQPGKPCYQPNTVIDHASYAFNSYWQQFKNSGGTCYFNGAATLVTQDPSRGSCTYPFT

SEQ ID NO: 276 - protein, 463 aa, Pinus radiata
MRRRMGLLFSVLVMFVWVGWVRGLGVNWGTQASHPLPPDILVGLLKDNGIKKVKLFDAEERAMRALAKSGIEVMAGIPNDQLQRMANSQKAAANWVEANATEFSLDGGVDIRYVAVGNEPFLKAYNGTFIQYTFPALQNIQNALNKAGLKNIKATVPLNADVYQGDTPSEGQFRPDINDLMIQICQFLASNGAPFTVNIYPFLSLYTNENFPVDFAFFDGTGQPVIDGNIQYTNVFDAALDTLFWALKRAGFPDLPVLVGEVGWPTDGDKHANINFAQRFNQGLLKHIMNGRGTPLRPQNIETYLFSLVDEDAKSIAPGNFERHWGIFQYDGTPKYALDLSGQTQNTALVSAKGVKYLPRRWCVFNPSASPSVLTQLPDSITYACTHGDCTSLGFGSSCNSLDYQGNASYAFNSYYQVNNQQNGACGFSSLAIVTESDPSQGTCKFEIQIAVSAASNTMNSYL

SEQ ID NO: 277 - protein, 338 aa, Pinus radiata
MATNIILIVCIAIFCCSILAESAQIGVNYGMLGTSLPPAGQVVTLMKSNNIGKMKIFQADKDALKAFANSGIEVIVGVGNNELQLISSSQDAANGWVNDNIRPFYPATNIKYIAVGNEVLIKTTYGSYLVPAMRNIQTALQNANLQNNIKVSTTHSSDVSEGYPPSNGVFKDEVKDTMKSVLQFLLDHGSPFMGNIYPYFSYINNRAQITLDYALFKSTSTVVPDKGRSYKYLFDALVDTLVSAMEALGYPNIPLIVTESGWPSAEADVATVDNARTYNNNLIRHVLSNEGTPKRPGKSIETYIFALFNENKKNPGTEQHFGLFYPNQQHVYPVNFSP

SEQ ID NO: 278 - protein, 348 aa, Pinus radiata
MATFKDQSRIFLIGCVAIFCCSVLADGDKIGVDYGMTADNLPSPDEVVTLMKSNNIGKTRIYQENDVVLQAFANSGIDVIVGVANEELKNISSSQDSANRWVNEHIVPFYPATNVKYIAVGNEVLITLDNVQYVPYLVPAMNNIQTAIQNAKLQDSIKVSTTHRPDVSSGYPPSKGVFVDAVKDTMSQILNFLSQNGGPFMADVYPYFSYIGNTKDISLDYALFKSTSTVVQDGDHSYTNLFDAMVDTLLSAMEASGYPNIPIVITESGWPSAGAEVATIENAQTYNNNLIKHVLSNAGTPKRPGMSIDTYVFALFNEDLKPGDETEKHFGLFDPNTKQPVYSVNFSP

SEQ ID NO: 279 - protein, 511 aa, Pinus radiata
MKILSRFLLLLLLIASFSEVALGGPFVGVNIGTDVSNMPSASAVVALLKNQQITHVRLYDADRQMLTALANTGIEVVVSVPNNQLLGVGQSRSTAANWVNKNVAAYLPNTNITAIAVGSEVLTTIPNAALVLVPAMRFLHSALVAANLDGQVKVSTPHPAELILDSFPPSQAFFNSSWNSVMIPLLAFLRDTKSYLMLNVYPYYVYMQGNGVVPLDYALFRPLPPNKEAVDPNTLLHYTNVFDAVVDAAYYAMASLNFTNIPVVVTETGWPSMGDANEPDATVDNADTYNSNLVRHVLNSTGTPKLPGVAVNTFIYELFNEDLRPGGTSEENWGLFSANSTPVYVLHLNGAGSPLGNDTSAQTFCVALSGADNQLLQAALDWACGPGQADCSAIQAGQSCYTPDTVADHASYAFDSYYHKMNMAPGSCDFNGVGTITNTDPSHGSCIFQGSVSANGTSSVNGTVLGNETFPLTGTNITSLNSSAPHLQSQIHPILFPLVALPILFWNLPIL

SEQ ID NO: 280 - protein, 515 aa, Pinus radiata
MGSLNRSMVCSMLISVFFCFVFGALHMVSADFANKQALGINYGQVANNLPSPAIAVQLMKSINVGYVKIYDADSQVLTALANTSLPLVITVANEDIPNIASGSSNADQWVQKNVLPYYPATQIFMIMVGNEVLSNPQIQSTWSQLVPAMENLQASLVKHNLDDSIKVTTSVAMDALASSYPPSNGSFKADIAASIMQPMLSFLNRTDSYFFVDAYPYFAWSSNPVNISLNYVLFGVSTTEILDGQLQYSNMLDAQLDAVVAAMADLGFPQVKLAVSETGWPTKGAADEPGANVANAAKYNRRLVSRFSASPPVGTPRRPGAFIPVFVFALFNEDQKTGPVTERNWGVFYPNGTPVYNIDLSGGNQGSAYTPIIRSGTNNNTFSAPAGAPASAAAPIPTAAPITTAAAPIPTAAPITTAAPTPSTLQQWCVAKSGVNNMTAVQQALDYACGAGADCSAIQAGNACYQPNTVEAHASYAFNSYWQSTKSNGGTCYFNGVAALTTSDPSFQGCSFPFQ

SEQ ID NO: 281 - protein, 325 aa, Pinus radiata
MASSNKVGVCYGMVANNLPLPDQVANLIRSRNIGKVRLFQAHHEAQRALQNSGGIEVIVGVGNDELQKIASDQAAANGWVNDNIRQFYPATNIKYIAVGNEVFSSENRQHLPYLVPAMRNIQTAVQNANLQSSIKVSTTHATSVLGNSYPPSQGEFADELKSSMSDVLNFLAENGSPFMANVYPYFSYIYNQAQISLDYALFKSADPVVSDEGRLYKSLFDALVDSLISAMEKSGHPDIPIVITESGWPSAGNEAATVENAQTYNNNLIKHVLSNAGTPKRPGQHIDTYIFALFNENLKGGDEPERHFGLFYPDQNLVYPVNFSP

SEQ ID NO: 282 - protein, 494 aa, Pinus radiata
MWVLPLLLLLLFLFCPFILGARVNGGAFVGVNIATDLSNMPSPSQVVSLLQTQQIKHVRLYDVERDMLLALANTSIQVVISIPNNQVLAIGESNSSAANWVKKNVADYLPNTNITGIVVGNEVLTTLPNAALVLVSAMKFLQSALVAANLDQQVKISSSHSSDIILDAFPPSQAIFNQSFNDIIGPMLEFLQDTGSYFMMNLYPYYTFMEGKGKVPLDYALFEPLTPDKEAVDPNTLLHYTNVFDALVDAAYYSMGNLNYTNIPVVVAETGWPSDGDATEPYATINNADTYNSNLVIHVLNITGTPKRPTIPVNTYIYELYNEDLRPGPLSEQNWGLFFANSSPVYVLHLTDAGEFLANDTTNQTFCIAKPGADLKLLQAALDWACGPGEANCTAIQGGEDCFNPDTVEAHSSYAFDSYYHNTGMAAGSCDFKGVAIITTTDPSHGSCVYPGSGGANQTSASKNNTSVSGSMDMGHMDNSVLMMLHILLLFLWF

SEQ ID NO: 283 - protein, 361 aa, Pinus radiata
MKALILVGGFGTRLRPLTLSVPKPLVDFANKPMILHQIEALKAIGVDEVVLAINYQPEVMLSFLKAFETKLGIKITCSQETEPMGTAGPLALARDKLIDGSGDPFFVLNSDVISEYPLKQMIDFHTKHGGEASIMVTKVDEPSKYGVVILDEETGKVERFVEKPKVFVGNKINAGIYLLNPSVLDRIELRPTSIEKEVFPKIAQEKQLYAMVLPGFWMDIGQPRDYISGLRLYLDSLRRNTSDKLATGVNIVGNVIVDSTAQIGEGCLIGPDVAIGPGCVIEAGVRLSRCTIMRGVRIKKHACVSGSIIGWHSTVGQWARVENMTILGEDVHVSDEVYSNGGVVLPHKEIKSSILKPEIVM

SEQ ID NO: 284 - protein, 415 aa, Pinus radiata
MSIGDRKSVAVIMVGGPTKGTRFRPLSLNLAKPLFPLAGQPMVHHPILACKKIPNLAHIYLIGFYEEREFALYVSSISNELKIPVRYLREDKPHGSAGGLYHFKDLIMEDDPANIFLLNCDVCCSFPLADMLEAHCKYGGMGTILVIKVSAESANQFGELVADSVTGELLHYAEKPETFVSDRINCGVYVFTPDIFLGIQDVSTQRKDRATMRRVSSFEALQSATKALPTDFVRLDQDILTPLAGKKKLYTYETSDFWEQIKTPGMSLRCSSLYLSQYRLTSPELLAKSNGGRTATIVGDVYIHPSAKVHPTAKIGPNVSISANARIGAGVRLIGCIILDDVELKENSIVMHSIVGWKSSIGRWSRVQGEANYTSKLGITILGEDVTVEDEVVVANCIVLPHKMLNMSVQEEIIL

SEQ ID NO: 285 - protein, 361 aa, Pinus radiata
MKALILVGGFGTRLRPLTLSVPKPLVDFANKPMILHQIEALKAIGVDEVVLAINYQPEVMLSFLKEFEAKVGIKITCSQETEPMGTAGPLALARDKLDDGSGEPFFVLNSDVICEYPLKQMLEFHKKHGGEASIMVTKVDEPSKYGVVILDEETGRVDRFVEKPKIFVGNKINAGIYLLNPSVLNMIELRPTSIEKEVFPKIASKKQLYAMILPGFWMDIGQPKDYISGLRLYLDSLRRNLPKKLSFGAHIIGNVIVDETAQIGEGCLIGPDVAIGPGCVIEAGVRLSRCTVMRGVRIKKHACVSGSIIGWHCTVGQWARVENMTVLGEDVHVCDEVYSNGGVVLPHKEIKSSITKPEIVM

SEQ ID NO: 286 - protein, 414 aa, Pinus radiata
MAGEGKVIAVIMVGGPTKGTRFRPLSLNIAKPLFPLAGFPMVHHPILACKKIPNLAHIYLIGFYDERLFSLYLSNVSSELKIPVRYLCEDKPHGSAGALFKFHDLLMEDNPKEIFVMHCDICCSFPLVDMQMAHRNYGGIGTMLVKKVSTEATGKFGELVADPLTKELLHFAEKPETHVSDYINCGVYIFTPDIFVTMQTLTPTRKERGIFRRLSSFESLEFSSPSVQKDVIRLDEDLFTPLVGKKMIYTFETSDFWEQIKTPGMSLRCSSLYLKQYHMKTPELLSSADAIMTVNIIGDVYIHPSSKIHPTAKIGPNVSISANARIGPGVRLRDCIILDDVEVQDNAIVMHAIIGWKASIGKWARVQGERNYGAKNGISILGEAVTVEDEVVVLSSTVLPHKALNQSVQGEIIL

SEQ ID NO: 287 - protein, 360 aa, Pinus radiata
MKALILVGGFGTRLRPLTLSLPKPLVDFANKPMILHQIEALKEAGVDDVILAVNYQPESMMKFLTEFEAKLGIRIQCSREIEPLGTAGPLALAKDKLIDGSGQPIFVLNSDVICEFPLKEMLEFHKSCGAEASVMVTRVDEPSKYGVVVLDEETGRVKRFVEKPQMFVGNKINAGIYLLNPSVLDRIELKPTSIEKDIFPRIAEENQLYAMVLPGFWMDIGQPRDYLTGLRLYLDYLRTKSDVLASGSQFQGNVLIDESVQIGEGCLIGPDVSIGPGCIIEAGVRLSNCAIMSGVRIKKHACVSWSIVGWHSTVGQWARAENMTILGEDVHISDEIYSNGGVVLPHKEIKSNILKPEIVM

SEQ ID NO: 288 - protein, 247 aa, Pinus radiata
MDCRKAGVLALFDVDGTLTPARKVVSQEMLEFMQELRKVVAVGVVGGSDLAKITEQLGKTVISDYDYVFSENGLVAHKGSKAIGNQSFKAFLGDEKLKELINFTLHYIADLDIPVKRGTFIEFRSGMLNVSPIGRNCSQEERDEFERYDKVHGIRTKMVEVLREKFAPLNLTYSIGGQISFDVFPQGWDKTYCLRYVENDFQEIHFFGDKTYKGGNDHEIFESSKTIGHTVTSPEDTRRQCTELFFQ

SEQ ID NO: 289 - protein, 1024 aa, Pinus radiata
MAGNEWMNGYLEAILDGGGVGDDNDYTRQKKESSVKSGVTVIPQLGAFNPARYFIDEVVHGTDETDIHHFWVKVTATKNPEERNTRLENLCWRIWHISRRKKKGKLEQSKRLQKLRQERERGRRDVTEDMSEDLSEGEKLGGDGQGLKFSESHYNLELLTEQSLKGKRLYVIMISLHGLVRGENMELGRDSDTGGQVKYVVEFAKALAKMPEVYRVDLLTRQICSPDLDSSYGEPTEMLTSDQDDDILESGGAYIVRIPCGCKEKYIQKELLWPYIPEFVDGALGHILNISKALGDLIGEDTPVWPHVIHGHYADAGDAACLLSGALNVPMVLTGHSLGRNKLEQLLKQGLHSKEDINATYKIMRRIEAEELCLDSAELVVTSTRQEIEEQWGLYDGFDLELNRKLRQRAKRGVHSYGRYMPRMSVIPPGMDFSNVVVHDENSDNDLDNDSVQLPESPLWGEIPRFLNNPSKPIILALARPDPKKNMATLVKAFGECIKLRKLANLMLIMGNRDDIDQMPAASANVLTTVLKLIDKYDLYGEVAYPKHHKQSEVADIYRIAAKTKGVFINPALVEPFGLTLIEAAAHGLPMVATKNGGPVDIQRTLNNGLLVDPHNDKEIAAALYRLVVDKNLWVECRQNGLQNIHLYSWPQHCRTYLSRISQCRMRHPQWQSENDQNENMDSESDSGSFKDAPDTSLRLSLDADRPSRSSSVNSPFDLDKLLQNEENVGGISEHIRMIIEKTKDNQSKLGDTNDVNSQEKQSIEHSNSLGSSGKHLLRRRKRLFVIAVDCYDASGEPLLSRQAIIIQEIMNAVCSAGNFSSPGFILSTALTVPETISMLQSIGIKVSAFDALICSSGSQLLYTAGDNPDSPIYPDPDYDSHIDYRWGAEGLRKSMKKLRGPENSRFLAEDAEASNFHCLAYQVKNISTAPKADELRRQLRMRGLRCHVIYTQNCSRLRVLPLHASRSQALRYLYVRWGLDIANMYVFLGEKGDTGYEELIGGMHKTLILKGTVVDGSEKMLRS

SEQ ID NO: 290 - protein, 1024 aa, Pinus radiata
MAGNDWINGYLEAILDAGAGFTEAETRPALTVADGGGFNPTKYFVEEVVTGFDESDLHRTWIKVVAMRNSLERNNRLENMCWRIWHLARRQKQIEWDDAQRLAKRRIEREQGRRDATEDMSEDLSEGEKADVATPRATPKRAFSRNFSDLQVWSDDNKGKRLYIVLISLHGLVRGENMELGRDSDTGGQVKYVVELARALSMMPGVYRVDLLTRQISSPDVDWSYGEPTEMLSSGSYDVDGHGGGESSGAYIIRIPCGPRDKYIPKELLWPYIQEFVDGALGHILNMSKVLGDQAGKGDPVWPYVIHGHYADAGDSAALLSGALNVPMVLTGHSLGRNKLEQLLKQGRQSKEDINATYKIMRRIEAEELSLDAAELVITSTKQEIVEQWGLYDGFDVRLEKILRARAKRQVSCHGRFMPRMVVIPPGMDFSNVVVADQEPAEADGDLAALINGDVNLSPKALPPIWSEVMRFFTNRHKPMILALSRPDPKKNLTTLVKAFGECRPLKELANLTLVMGNRDDIDEMSGGNAAVLTTVLKLIDKYDLYGQVAYPKHHKQSDVPDIYRLAAKTKGVFINPALVEPFGLTLIEAAAYGLPMVATKNGGPVDIHSTLTNGLLVDPHDQKAIANALLELVADKNLWNECRRNGLRNIHLFSWPEHCRKYLSRVAVCRMRHPQWQTDTLMDTTMDEESMGDSLKDVQDMSLRLSVDGEKYSVNGSLDNSAEVDKLLAAKGDPETYNQVKRILDKLKKGPPSSITQETEPKPDVNEPRAPANNVSVSNKYLALRKKRKLFVIAVDCYDDTGNVSPRMLEIIQEIIKAVRSDATAARFAGLVLSTALTVDEILGMLNSGNILPHEFDALICSSGSELYYPTIPAYPDDGSNKKLCPDPDYDSHIDYRWGGEGLRKTMSLLTASERDGQEKQERVIFEDAKHSNAHCLAYVVKDSTRVRKVDEFRQRLRMRGLRCHPMFCRNSTQLHVIPLLASRSQALRYLFVRWGLDVANMHVFVGETGDTDYEEMLAGLHK

SEQ ID NO: 291 - protein, 275 aa, Pinus radiata
MDTPLHLLFLLLASSAALASANFYNDVDITWGNDRAKILDNGQQLQLTLDRSSGCGIQSKQEYLFAKIDIQMKLVPGNSAGTVTTFYLSSQGPKHDEIDFEFLGNLSGDPYILHTNVFAQGLGGREQQFYLWFDPTLDFHTYSVLWTSNQIIFSVDGSPVRVFKNRETELGKVDSNYHYPKTQAMRVYSSLWNADDWATRGGLVKTDWTKAPFVASLRNFNAAATSSFDAAAEEVALESNQEQRQRLQWVRKNYMIYDYCADTKRFPQGPPPECK

SEQ ID NO: 292 - protein, 273 aa, Pinus radiata
MDTPLHLLFLLLASSAALASANFYNDVDITWGNDRAKIIDNGQELQLTLDRSSGCGIQSKQEYLFAKIDIQIKLVPGNSAGTVTTFYLSSQGPKHDEIDFEFLGNLSGDPYILHTNVFAQGLGGREQQFYLWFDPTLDFHTYSVLWTSNQIIFSVDGSPIRVFKNRETEMGKVDNNYHYPKSQAMSVYSSLWNADDWATRGGLVKTDWTKAPFVASFRNFSAATASSFDAAAEEAALESNQEQRLEWVRKNYMIYDYCGDTKRFPQGPPPECK

SEQ ID NO: 293 - protein, 274 aa, Pinus radiata
MEMGKPLLFLFLLISSSLLLIVSANFYNDVDVTWGNGRGQILDNGQQLQLTLDPTSGSGFQSKKEYLFAKIDMQIKLVPGNSAGTVTAYYLSSQGPKHDEIDYEFLGNLSGDPYIMHTNIFAQGLGNREQQFYLWFDPTLAFHTYSVLWTPNQITLSVDGIPVRVFKNRETELAKVDSNYHYPKSQAMRVYSSLWNADDWATRGGLVKTDWTKAPFVASFSDFNAATSSSNFAGEGALDSNQGQKLQWVRNKYMIYDYCADTNRFPQGLPAECK

SEQ ID NO: 294 - protein, 272 aa, Pinus radiata
MDTPLLFLLLLISSTLLLTVSANFYNDVDITWGNDRAKILDNGQQLQLTLDRTSGCGFQSKEEHLFAKIDMQIKLVPGNSAGTVTAYYLSSQGPKHDEIDFEFLGNLSGDPYIMHTNVFAQGLGNREQQFYLWFDPTLDFHTYSVLWTSNQIIFSVDETPVRVFKNRETELGKVDSNYHYPNSQAMRVYSSLWNADDWATRGGLVKTDWTKAPFVASFSDFNAATSSSNFDGEDVLDSNEEQKLQWVRKNYMIYDYCADTKRFPQGLPAECK

SEQ ID NO: 295 - protein, 275 aa, Pinus radiata
MDTGTPLLFLFLLITSSSLLVIVSANFYNDVDITWGDGRGKILDNGQQLQLTLDRTSGSGFQSKNEYLFAKVDMQIKLVPGNSAGTVTAYYLSSQGPKHDEIDYEFLGNLSGDPYIMHTNIFAQGLGNREQQFYLWFDPTLAFHTYSVLWTPNQITFSVDETPVRVFKNRETELGKVDSNYHYPKSQAMRVYSSLWNADDWATRGGLVKTDWTKAPFVASFRNFSAATSSSNFAAEEALDSNQEQKLQWVRNNYMIYDYCADTKRFPQGLPAECK

SEQ ID NO: 296 - protein, 305 aa, Pinus radiata
MQTHHSESSLLLLVLAFEIALFFLIFNRLLSIIITDMDTPLLFISLLSLASLVVTVSANFYNDFDITWGNDHAQILDNGNQLQLTLDHTSGCGCQSKEEYLFAKIDMQIKLVPGNSAGTVTTYYLSSQGPKHDEIDFEFLGNLSGDPYVMHTNIFAQGLGNREQQFYLWFDPTLDFHTYSVLWTPNQIIFSVDGTPVRVFKNREKELGNNFHFPNSQAMRIYSSLWNADDWATRGGLIKSDWSKAPFVAYFSNFSAVISSSNFVIEEDLDSNQEQKLQWVRNNYMIYDYCADTKRFPQGLPPECK

SEQ ID NO: 297 - protein, 274 aa, Pinus radiata
MDMGMPLLFLFLLITSSSLLVTVSANFYNDVDITWGNGRGKILDNGQQLQLTLDRTSGCGFQSKNEYLFAKIDMQIKLVPGNSAGTVTAYYLSSQGSEHDEIDYEFLGNLSGDPYIMHTNIFAQGLGNREQQFYLWFDPTLDFHTYSVLWTPNQIFSVDGIPVRVFKNRETELGKIDSNYHYPKSQAMRIYSSLWNADDWATRGGLVKTDWTKAPFVASFSNFSAATSSSNFAGEEALDSNQEQKLQWVRKNYMVYDYCADTKRFPHGLPAECK

SEQ ID NO: 298 - protein, 351 aa, Pinus radiata
MMLAVALVCIWVCGLFSQPGSAVGSSRPRLAGKLVTENFAGLQFEEAYTSLFGDENVKVAEDGKTVMLSLDKRTGSGLLSQDMYLYGLFSASMKLPDDYTAGVVAAFYTSNGDMFPGTHDELDFEFLGNIRGKEWRIQTNVYGNGSTAYGREERYTLWFDPTEDFHQYTILWTEKSTVFFVDDVPIREIPRTDAMGAHYPGKPMSVYATVWDGSDWATKGGRYRVNYKYSPFVVTLANLILEGCAVDPLEQFPAVSCSADTTSSASLSKLAELSEDQKALMEWFRGKYISYSYCDDAVRYPSNPSDCPPRDPHKKIATAHVKFGHHQRHHKKNRKSRRSSSSSAASAAVSL

SEQ ID NO: 299 - protein, 351 aa, Pinus radiata
MMLAVALVCIWVCGLFSQPGSAVGSSRPRLAGKLVTENFAGLQFEEAYTSLFGDENVKVAEDGKTVMLSLDKRTGSGLLSQDMYLYGLFSASMKLPDDYTAGVVAAFYVSNGDMFPGTHDELDFEFLGNIRGKEWRIQTNVYGNGSTAYGREERYTLWFDPTEDFHQYTILWTEKSTVFFVDDVPIREIPRTDAMGAHYPGKPMSVYATVWDGSDWATKGGRYRVNYKYSPFVVTLANLILEGCAVDPLEQFPAVSCSADTTSSASLSKLAELSEDQKALMEWFRGKYISYSYCDDAVRYPSNPSDCPPRDPHKKIATAHVKFGHHQRHHKKNRKSRRSSSSSAASAAVSL

SEQ ID NO: 300 - protein, 293 aa, Pinus radiata
MARIIPIVLASAILLVASLQSEVNAANQIFNADFQILFASDHVKTSDDGQIWELMLDKKSGSGFQTKNSYRFGFFTMKLKLVAGDSAGVVTTYYMASKDFETRDELDFEFLGNVSGQPYALQTNIYVNGVGGREQRNELWFDPTADFHTYSFLWNDHQLIFFVDLVPLRVHRHTNVTDNVYPKNRPMSLLSSIWNADNWATRGGLDKTNWSYAPFISSYQNFNADACMWEDPFPACVSTTGENWWDKPPAWTLTDAQKLDYAWARRNFLIYDYCQDTKRFNGTLPVECSVGPW

SEQ ID NO: 301 - protein, 282 aa, Pinus radiata
MGLVGRMMHWPCVLGSIVVLCSLIVGSQCAAFNDFFYPSWALDHVMYEGELLKLKLDNTSGAGFASKSTYIFGKVNVQIKLVPEDSAGTVTAFYMSSQGDQHDEFDFEFLGNTSGEPYAVQTNVFSKGVGKREQRIFLWFDPTTDFHSYSFLWNRQQVVFFVDDVPVRVFGNNEKVGVPYPQSQPMGVYSSIWNADDWATQGGLVKTDWSHAPFVSTYTNFSIDACDYSLKTTCSSWWDEPAYASLDAKQRLKLKWVQEKYMTYDYCKDSARFPTPPPECSA

SEQ ID NO: 302 - protein, 305 aa, Pinus radiata
MCLQRICWVRAMLIKMVPKLLLVLLVAAMAAMAASPPKPVDVPFPKNYVPTWAADHIKYINGGNEVQLSLDKWTGTGFQSKGTYLFGHFSMQIKMVPGDSAGTVTAFYLSSQNAEHDEIDFEFLGNRSGQPYILQTNVFSGGKGNREQRIYLWFDPTKDYHAYSVLWNMHQIVFFVDDVPIRVFKNSRDLGVRYPFNQPMKIYSSLWNADDWATRGGLEKTDWSKAPFVASYRGFHVDGCEASVTESTCATQGRRWWDQKAFDDLDGMQWRKLKGVRNSYTIYNYCADKVRSPAMPPECTRDRDI

SEQ ID NO: 303 - protein, 294 aa, Pinus radiata
MLINMVPNVLLFLLVAAMAATATPPPKPVDVPFQKNYVPTWASDHIKYINGGNEAQLSLDKWTGTGFQSKGSYLFGHFSMQIKMVPGDSAGVVTAFYLSSQNSEHDEIDFEFLGNRSGQPYILQTNVFSGGKGDREQRVYLWFDPTKDYHSYTVLWNMHQIVFFVDDVPIRVFKNSKDLGVRYPFNQPMKIYSSLWNADDWATRGGLEKTDWSKAPFVASYKGFHVDGCEASMPHSACPTLGRRWWDQKAFDDLDGQQWRKLKWVRDRYTIYNYCTDRVRYPKMSPECTRDRDI

SEQ ID NO: 304 - protein, 307 aa, Pinus radiata
MGGTWRTVGLSFLFLVFSSLIASVCSQSQGDDSSAKVFDDNFQIMWAEDHFRTSENGQVWHLVLDQNSGSGFKSKYKYRFGWFSMKLKLVPGDSAGVVTAYYMSSNTDMNRDELDFEFLGNRSGEPYALQTNIYAKGVGGREQRHILWFDPTTQFHTYSILWNSHQIVFFVDQVPLRVHRHTEATSDVFPKEQGMYMFSSIWNADNWATRGGLEKTNWTAAPFVSSYKKFHGLGCKWGDDNTTLLPCANDKNASASHWWDEAVAWTLTKKQRENYRWVNSKYLLYDYCNDQSRYSIKPVECSVAPWD

SEQ ID NO: 305 - protein, 307 aa, Pinus radiata
MGRTWRAMGMSFLVLVLIGLIACVSCQSDGDDSSPKVFDDNFQILWAQDHFRTSENGQVWHLVLDQNSGSGFKSKNKYRFGWFSMKLKLVPGDSAGVVTAYYMSSDTDMNRDELDFEFLGNRSGQPYGLQTNIYSNGVGGREQRHILWFDPTTEFHTYSILWNAHQIVFFVDQVPLRVHRHTKATRHVFPRKQGMYMFSSIWNGDNWATRGGLEKTNWAAAPFVSSYKKFHGLGCKWEDQNTTQSSCAHSNNASARHWWDKPEARTLTKKQREYYRWVNSKYLTYDYCHDQPRYPIKPVECSVAPWD

SEQ ID NO: 306 - protein, 290 aa, Pinus radiata
MAGQRNWFKRIEFIVIFVVCLNSVSARPASFAEDFKVTWADDHVKTRSDNNSIDLILDQNSGAGFASKNQYMFGLVSMNIKLVAGDSAGTVTAFYMSSDKEEVRDELDFEFLGNRSGQPYTVQTNVFALGKGGREQRVNLWFDPSLEFHRYSILWNHYHIVFSVDDIPIRVYKNNEARGVPFPKNQSMGIFSTLWEADNWATRGGLEKIDWSKAPFVASYRGFEIESCQYPGNASCVVNTSNWWEGLSYSGLRPNQARLYKWVRTNYMIYDYCKDTPRYPVLPTECNAGI

SEQ ID NO: 307 - protein, 291 aa, Pinus radiata
MEVSSASCLRGYVHFLLTAIICTAISPTVYADIYSDIDVTWGENNAWVLNNGQGLQLSLTNYSGSGFQSYKEFLFGSVDISMKLVPGNSAGTVTTYYLSSTGEGHDEIDMEFLGNVSGEPYILHTNIYVNCSADKEQQFYLWFDPTADFHNYSILWNPQQIAIFVDGLPIRVFANNENIGVPYPNEQAMRVFSSIWNGDQWATQGGRVKIDWSSSPFVASYMNFNTDVCEWNGNGSTSQCWATNWWNQNNLNYGQQGQLQWVRSNYLIYDYCKDYARFNYQLPAECAQQPQ

SEQ ID NO: 308 - protein, 298 aa, Pinus radiata
MCSEAMKTAQFLGLFLILLLHSAAMAATPKPVSVPFGKNYGASWGSDHIKEFHGGRKVELLLNKQYGAGFESKGTYLFGHFSMQIKLVPGDSAGTVTAFYLSSQTAEHDEIDFEFLGNRSGQPYILQTNVFTGGKGEREHRIYLWFDPTKDYHSYAVLWNMYQIVFFVDSVPIRVFKNCKNLGIRFPFNQPMKIYSSLWNADNWATRGGLEKTDWSKAPFTASYKQFHVDACEASVSESVCATQGRRWWDQVEFRDLDGRQWRFLKWVRKHYTIYNYCTDAARNKKMPPECVRDRDNI

SEQ ID NO: 309 - protein, 265 aa, Pinus radiata
MYDCKRQNTIKPFTGHFHALLVLAFVLIVSVCPNADHVRVSEAARRGHKGRYPRASQFPTVAFNRGFHVLWGPQHQTIWNDQSGITIWLDRNSGSGFKSLRPYKSGYFSAAIKLQAGYTAGVNTAFYLSNNEAHPDYHDEIDIEFLGNIPGRPYTLQTNIYVRAGNAGRGRIITGREQQIHLWFDPTKDFHRYSILWTPLKIIFFVDDIPIRKYRRTNPYTFPARPMWLYGSIWDASPWATDNGKYKVDYSYQPFVAQYRGFVLA

SEQ ID NO: 310 - protein, 282 aa, Pinus radiata
MAGYEGRRICIYWWVITVMLCRLVVGSQCAAFNDLFYASWAADHVMSQGDLLQLKLDHTSGAGFASKSTYLFGKVNVQIKLVPGDSAGTVTAFYMSSQGDQHDEFDFEFLGNTSGEPYVVQTNVYSNGVGNREQRIYLWFDPTANFHSYSFLWNRHQSVFFVDDVPIRVFSNNEKRGVPFPQTRPMGVYSSIWNADDWATQGGRVKTDWSHAPFISTYTSFNIDACKYSPGSSCTSWWDQPAYASLTAKQRMQLKWVHEKYMIYDYCKDPVRFGTPPAECTA

SEQ ID NO: 311 - protein, 288 aa, Pinus radiata
MSTNGAYLWALVWASVISAGLGLGNGNFDDDFYIMWAPDHVTRLYNGHGVQISMDRQSGSGFATKKQYLFGKFEMQIKLPPGNSAGTVVAVYLYSNQPNRDEIDIEFLGNVDGKDIIMQTNVFANGYDDREQRIKLWFDPTADFHTYTIFWNRYHIVFLVDGFPIRVHQNNAVRGIPFPRMQPMSLYTTIWNGESWATNGGKTKITWEPYPFVAQFRNFYIDGCEWNGNPRFCKGGSTQNWWNKRTYAYFNAGDRLKLHWVRKHYLVYDYCNDKVRFKVAPEECRYHI

SEQ ID NO: 312 - protein, 263 aa, Pinus radiata
MAFIRKLPLLVLAFMLVLSVAHIQVSEAAGRPQSSHGTAYPLRSQLSAVKFNQAFDVLWGPQHEQVSNDESGITIWLDRNSGSGFKSQRAYDSGYFSAAIKLQAGYTAGVNTAFYLSNNEVHPDSHDEIDIEFLGTIPGQPYTLQTNIYVRAANGGTERIITGREQQIHLPFDPTSDFHRYSILWTPSKIVFSVDNVPIRKYSRTGSAFPTRPMWLYGSIWDASSWATDNGKYKVDYNYQPFVARYTDFILTDCTQSRAAECS

SEQ ID NO: 313 - protein, 295 aa, Pinus radiata
MEAPNLSGYLHLVLMIVIIWSTGIYPTVHANFYNDIDIAWGYNNVNIFDNGEELQLSLNNASGSAFQSKAQFLFGSVDMFMKLVPKNSAGTVTTFYLSSTGDRHDEIDLEFLGNVSGQPYILHTNIYTNGSGNREQEFYLWFDPTSEFHNYSILWNPQQIVLFVDGLPIRVFGNNEDIGVPYANGQAMRAYSSIWDGDSWATQGGRVKIDWSYSPFVASYRNFTADVCEWTGSGSSSQCWANIPSNWWNQAAYESLTYAQQGQLQWVRNNFLVYDYCKDPARFNNQLPAECYRQP

SEQ ID NO: 314 - protein, 331 aa, Pinus radiata
MGTSGTSSQYSSSAFLQPRSCMNIIAVLIIFTLLNSIIPVHGESEKHIPVTSRFQTINFYNGYSNLWGPQHQQVSEDESSTTIWLDSSSGSGFKSLEAYKSGFFSAAIKLQAGYTAGVIAALYLSNNQEYPGHHDEIDIEFLGTTPGKPYTLQTNVYINGTGDGQVLTGRELKFHLWFDPTEDFHNYSLLWTPSYIIFYVDDIAIRKYPRRISSTYPLRPLWVYGSIWDASSWATENGKYRADYRYQPFVAKFSKFILSGCPVSDSTCSATFSNSLISTGTGGLTSQERSRMKSIQTNNLVYNYCKDRERYPTRLPECGKRYAPSLINGND

SEQ ID NO: 315 - protein, 285 aa, Pinus radiata
MAFVGCQEGGRVMHCALLCIFVTLCNLLVSSQCASFDDFFYPSWAVDHVMSQGELLQLKLDNISGAGFASKSTYIFGKANVQIKLVPGDSAGTVTAFYMSSQGDQHDEFDFEFLGNTSGEPYAVQTNVYSKGVGNREQRIFLWFDPTADFHSYSFLWNRQQVVFFVDDVPVRIFSNNEKRGVPYPQTQPMGVYSSIWNADDWATQGGLVKTNWSHAPFISTYKNFSIDACQYSSKTNCSSWWDQPGYASLDAKQRLKLKWVHEKYMTYDYCKDSARFPTPPAECE

SEQ ID NO: 316 - protein, 342 aa, Pinus radiata
MASTGSQDDSAYRYTTIIRKQGHYQKHGSRHHLSASTGIQVVMVMAFFLVSSSSAARISSRPLLRDQNRTATTVDFDQNYDITWGNQLVKFLDNRRSVELRMDQSSGSGFASKNKYLFGYFSTRIKLVPGDSSGTVTAFYLSTQQTSKHDEMDFEFLGNKPGKPHYLSTNVFVNGVGNRESRIRLWFDPTADFHTYSLLWNRHQILFMVSGVVVRVFKNSETSLGVPYPSSKPMQVIASLWNGENWATDGGKSKINWKQSPFIATFEGFDIEGHKCEGDSESSPFCPSSPSSEWWEDLGSKGLSAEQMRQLRWVRRNYMDYDYCTDKTRFPKPPPECALNTI

SEQ ID NO: 317 - protein, 299 aa, Pinus radiata
MLREAMKTAQFLGLFLILLLHSAAMAATPRTPVSVPFGNNYVASWGADHIKEFHGGRKVELLLNKQYGAGFESKGTYLFGHFSMQIKLVPGDSAGTVTAYYLSSQTAEHDEIDFEFLGNRSGKPYILQTNVFTGGKGEREHRIYLWFDPTKDYHSYAVLWNMYQIVFFVDSVPIRVFKNCKDLGVRYPFNQPMKLYSSLWNADDWATRGGLEKTDWSKAPFLASYEQFHVDACEASAPQSACATQGRRWWDQEEFRDLDGRQWRYLKWVRKQYTIYNYCTDISRNAKMPPECVRDRDNE

SEQ ID NO: 318 - protein, 293 aa, Pinus radiata
MKRRAKLLGFGINWRKIVYISSVVNLILSSVESSSFNDNFDISWGTVQLLNNGQTAQLTMDKASGSGFQSKDEYLFGSLSMSIKLVSGNSAGTVTSYYMSSDAASHDELDYEFLGNLPGNPYTLQTNVFANGVGNREQRLNLWFDPTADFHNYSILWNHNQIVFWVDSIPIRVFKNNEETAGIPYPNSRPMRILSTLWNGENWATDGGRVKIDWSKAPFVASYQSFEVNACSAPSNSSLPCANNWWEQPEFQSLDESQLGKLDWVRKNYMTYDYCHDTSGRFSTTPAECAFNA

SEQ ID NO: 319 - protein, 285 aa, Pinus radiata
MKSHISLLGSRRSSPELVYLSLLIILNLCTVKATFSDNFEISWGNVRLLNNGQTVQLTMDKASGSGFQSKMDYLFGSLSMRIKLISGDSAGTVTSYYMSSEASQHDELDYEFLGNLPGQPYTMQTNVFASGIGNREQRLKLWFDPTADFHNYSILWNQKQIVFWIDSIPIRVFKNNEAAGVPYPDQRPMKIISTLWNGEDWATDGGRVKIDWNDAPFIASYQSFEVDACSSSPCVNDWWDQSTFQSLNQQQLTQLDWVRKNYMTYDYCNDASRYPTPPRECALNP

SEQ ID NO: 320 - protein, 329 aa, Pinus radiata
MATSFSFYKLVLVVALLLTNGANVVVMLVSADQSLQPPLPSQPVTRYFKTMAFDEGFSNIWSPDHQNVSQDRNSVTLKIDRYSGAGFKSKKTYLYGFFNAALKLQAGYTAGIVTTFYLSNSDVYPDLHDELDFEFLGTIPGEPYTLHTNIYGNGSGDGNITSRIGREQRFHLWFDPTQEFHNYTILWTPHQIMFFVDSIPIRQFRKLKSVRKQYPGKPMSIYATVWDGSDWATDGGKHRANYSYEPFLSTYTNFIISGCTAGQPDCKPGRLDHRFPPILSKAQKEDLHFVRKNYMIYDYCHDTSRYPKGLPECPRSFPRRSPVFRPRHV

SEQ ID NO: 321 - protein, 173 aa, Pinus radiata
MAAPKSSNLSLLALIILLMGGTHHAVGMDLKKTEIEFYMHDVVTASKNFTTMKVAHSPEFGMIRVIDNALTEDLQQNSKELGRARGMYVQDSFSGVNLLMVLTVIFQAGEHSGSTLCLQGQDGRKQREISVVGGTGHFRHATGHAILEKQLSMGENAILNFNVTVLHRSELAE

SEQ ID NO: 322 - protein, 182 aa, Pinus radiata
MATKGFLETTIAVSAVLLLVCLHIAEAEVKTKLGREKISHLHFYFHDVVTGKNATAVQVASAPTTKYSPTGFGAVVVMDDCLTAGPEATSKLVGRAQGIYVSSGQEDFHLLMATTFVFESGMYNGSTLAMIGKNAPLEEVREMPIVGGSGLFRFARGYALAHTHSIDGTTAVVKYNVTVLHY

SEQ ID NO: 323 - protein, 187 aa, Pinus radiata
MANKGYSAATITVAAVLLLSLFYLEAEAEAEAKLKLGREKISHLHFYFHDLVAGKNVTAVKVASAPTTNSSATLFGAVMVMDDWLTEGPEATSKMVGRAQGIYVSSSQEDFHLLMATTFVFESGKYNGSTLAMIGKNAALEQVREMPIVGGSGLFRFARGYALARTHAFELNTGNAVVEYNVTVLHY

SEQ ID NO: 324 - protein, 173 aa, Pinus radiata
MGPRFLFLAIIANVLLMFAAGEGEVNMVFYLHDNLTGTNVTAVPVAGLNGSSSNAGKFGTVVTISDVITRRPEISESDSDNIIGRAQGMYVDTNPVTGLDFLMVFTLIFEDKKYRGSTLEFQGTDRFAQPRREFAVVGGTGKFRFARGYAVANTESLSGVNAIIKFNGTIRTD

SEQ ID NO: 325 - protein, 182 aa, Pinus radiata
MKGFSAVNTAMAAVVLLVCLYLAVAEAKVKLGPEKISHLHFYFHDLVDGTNVTAVEVASAPTTDSYFTQFGLVRVMDDPLTEEPKATSKMVGRAQGIYVSSCQHRVQLLMATTFIFESGKYNGSTLAMVGKNAVFDDVREMPILGGSGLFRLARGYALARTHSLDLKTGNAVVEYDVTVVHY

SEQ ID NO: 326 - protein, 184 aa, Pinus radiata
MAIKGYSSVNITVAVYCYWFVLYLAAAEAEEKIGHGKISHLHFYFHDLVGGKNVTAVEVASAPTTDSYFTQFGLVRVMDDRLTKGPKVTSKMVGRAQGIYVSSCQHRLQLLMATTFVFESGKYNGSTLAMVGKNAVFDEVREMPIVGGSGFFRLARGYALARTHSFDLNTGNAIVEYNVTVLHY

SEQ ID NO: 327 - protein, 195 aa, Pinus radiata
MAIKKYNRDVHLCFVCLVLFTVMLQTSNGHRWKKHSLPKPCRNLVLYFHDVIYNGSNAKNATSTLVGAPQGANLTLLAGKDNHFGDLAVFDDPITLDNNFHSPPVGRAQGFYFYDMKNTFSSWLGFTFVLNSTDYRGTITFSGADPILTKHRDISVVGGTGDFLMTRGIATISTDAYEGDVYFRLCVNITLYECY

SEQ ID NO: 328 - protein, 196 aa, Pinus radiata
MAIKNHNTAVHLGFIWLVVFSAMLLQSSDAHSYMKRPLPKPCRNLVLYFHDVIYNGLNAMNATSTLVGAPQGANLTLLAGRDNHFGDLAVFDDPITLDNNFHSPPVGRAQGFYFYDMKNTFSSWLGLTFVLNSTDYKGTITFSGADPILKKYRDISVVGGTGDFLMARGIATISTDAYEGDVYFRLCVNITLYECY

SEQ ID NO: 329 - protein, 177 aa, Pinus radiata
MGSRVLLPAMATATIVIFLLHAAAGERETNLVFYMHDNVSGNNVTAFTVAGLNGTSSDPGKFGTIVVNWDAATKGAQATGTADPDNIVGRIQGMYVNTNLVTGLDFLMLFTVIFEDMEYKGSTLEFHGTDKFFAPHRELAVVGGTGKFRFARGYAILTTEVLSGPNAVVKFNTTLRY

SEQ ID NO: 330 - protein, 188 aa, Pinus radiata
MRKFNDNARSNINNIAVAAAATTFLFWVALTIFERHEMKEKTSYLQFYFHDIVSGKNVTAVEVASSPTTGSSFTEFGLVRVMDDWLTEGPEPTSKMLGRAQGIYVSSCQEKVHLLMTLTFVFDSGKYNGSTLAVVGKNAVFDEVREMPIVGGSGFFRFARGYALARTHSLDLTTGNAIVKYNVTVFHY

SEQ ID NO: 331 - protein, 195 aa, Pinus radiata
MAIENNNRAVYLCFVWLLLFTVLLQASDGHGWNKDPFRRPSRNLVLYFHDVIYDGTNAKNATATLVGAPHGANLTHLTAKDNHFGDLAVFDDPITLDNNFHSPPVGRAQGFYFYNMKNTFNAWLGFTFVLNSTHYKGTITFAGADPILTKYRDISVVGGTGDFLMARGIATISTDAYEGDVYFRLRVNITLYEWY

SEQ ID NO: 332 - protein, 196 aa, Pinus radiata
MAIKNNNRAVYLCFLIWLLVFTLSLRSSDGHGWNKYPFRRPSRNLVFYFHDVIYDGTNAKNATSTLVGAPHGAKLTHLAAKDNHFGDLAVFDDPITLDNNFHSPPVGRAQGFYFYDMKNTFSAWLGFTFVLNSTDYKGTITFAGADPILTKYRDTSVVGGTGDFLMARGIATISTDAYEGDVYFRLRVNITLYEWY

SEQ ID NO: 333 - protein, 189 aa, Pinus radiata
MAKLSAGVASNVNSIAVAATLLLLLLALTAEAKEGYDSKVEEKTSDLHFYFHDTVSGKNVTTMQVARASGTNSSPTLFGLAVVLDDIVTKGPEPASQLLGRMQGLYTLSGLEERAMQMVVTLVFSSGQYNGSTLSLVGINRIYHPVREIPIVGGSGLFRLARGYVLARTHSLVQNGNAVVECNVTVLHY

SEQ ID NO: 334 - protein, 184 aa, Pinus radiata
MAGKNYSTATIAVAVVLLFVCLHIAAVQAKVKLGNEKISHLHFYFHDLLVGKNVTAVQVASAPTTNNYFTQFGMVRVMDDWLTEGPEGTSKMLGRAQGIYVSACQEKFQLLMATTFVFESGRYNGSTLAMVGKNAVLEQVREMPIVGGSGFFRFARGYALAHTHSIDFKTGNAVVEYNVTVLHY

SEQ ID NO: 335 - protein, 174 aa, Pinus radiata
MASRCLFATLATATLVMAAAGEGVLNMAFYMHDHLNRNKDQTAFPVAGVNGSSSEASKFGTLVVISDMVTKRPQITEYDTENILGRAQGTYVNTNPVTGLDFLMVFSLIFQNAEYNGSTLEIQGTERFDQPHREYAVVGGTGKLRFARGYAVGTTVSTSGENAVLKINATFCTV

SEQ ID NO: 336 - protein, 173 aa, Pinus radiata
MASGILFPVMAIIVIVSLQPAAGESEMNMVFYLHDNLSGTNVTSFPVAGLNGSSSDAGKFGTLVVTSDVKTKGPNSGSDNIAGRAQGTYVNTNMVNGLDFSMVFTLIFEDMEYGGSTLVIRGTDRFDQPQCEYALVGGTGKFRFARGYAVVTTESVSAPNAVLKFNTTFLIPS

SEQ ID NO: 337 - protein, 180 aa, Pinus radiata
MAGFKFLFPAMAVTILVVFLKKAAAAAIEGEMNMVFYMHDNVKGNNVTAIPVAGTNGSSSPPGHFGTVVVISDVITKFPDVAESESQNIVGRAQGMYINTNLDTRRDFLMVFTVIFNNMEYNGSTLEVQGTDRFDQTQREYAVIGGTGKFRFARGYAVVTTESLSGQNSVLKFNTTLSTL

SEQ ID NO: 338 - protein, 192 aa, Pinus radiata
MAIKSGRALHLSFVWLVLSTALLQTSDVYSWKKKPLRKPYRNLVLYFHDVIYDGTNADNATSTLVGAPHWANLTHLTAKDHQFGDLAVFDDPITLDNNFHSPPVGRAQGFYFYDMKNTFSAWLGFTFVLNSTDHRGTITFAGADPILTKYRDISVVGGTGDFLMARGIATISTDAYEGDVYFRLCVNISLYE

SEQ ID NO: 339 - protein, 177 aa, Pinus radiata
MGSGVLFSAVAKTTLVLVFVQAAAGISETNMVLYMHDNLTGRNVTSFPVAGLNGSSSDPGKFGTVVIMSDPITKQPEVTDSDGNNYLGRAQGAYINTNPHTGMEFLMVFAITFESMEYNGSTLQIQGIERFDQPQREYFVVGGTGQFRYARGYVVCTMEYVSGENAVLRLNTTFRTD

SEQ ID NO: 340 - protein, 208 aa, Pinus radiata
MPVKPSSRELVHLCILWLLVSTVLLQVTDGFVWKKREYEKPNWNKVFYFHDVLYNGNNAENATSAIVAAPQGANLTSLTDNNHFGDLVVFDDPITLDNDMHSPPVGRAQGFYFYDMKNTFSAWLGFTFVLNSTEHRGTITFAGADPILTKYRDISVVGGTGDFLMARGIATISTDAYEGDVYFRLRVNTTLYECYNCLLSASASHDNQ

SEQ ID NO: 341 - protein, 272 aa, Pinus radiata
MKIFNNPLLFAVWALSMVSAALSCDRCLRKSKVASFARANINGACGYGNSATSLTARGGLVMASASAKIYRDGVGCGACYQIRCTDPGVCTKSGVKVLVTDFTKSTQTDFVLSARSFSKLAVASKAAQFLKMGTVDIDYKRIPCDYGSQNMTVKVDKSSKYPDYLAVQFLYQGGQTDITAVDIDRVGSSGWQYMTHKNGAIWGIQNPPIGSLSFRLLVTGGYDGSWVWPTRNLLPAIWRPGSVYDSGVQITEIAQEGCSPCETGNWTDTRTP

SEQ ID NO: 342 - protein, 246 aa, Pinus radiata
MAFLWLVSLGLLSMLRAAHGSGWTSAHATFYGGGDATGTMGGACGYGNLYSQGYGTNTAALSTALFNNGFSCGACYEIQCNDDLQWCLPGSIVVTATNFCPPNNALPNDNGGWCNPPLEHFDLSEPVFQHIAKFRAGIVPVQYRRVPCQRKGGIRFTINGHSYFNLVLITNVGGAGDVEAVSVKGAKTGWQPMSRNWGQNWQSNSYLDGQSLSFKVTTSDGKTVTSYNVASSNWQFGQTFAGEQMN

SEQ ID NO: 343 - protein, 280 aa, Pinus radiata
MRRTVGLQWPLVPNVCVNVTAFCFVLLLLFSCKEAALGLEHTELNRDDLEWRPATATWYGSPDGDGSDGGACGYGGLVDQKPLRARVGAVSPVLFKGGEGCGACYKVKCMEKGLCSEKPVTVVITDECPGGYCAFGRTHFDLSGAAFGRMATNGKTPALLNTGELPVLYRRTLCEYPGKNITFHVTEGSTAYWFSILIEYEDGDGDVGAMHLKQADSDAWMEMNHVWGANWCLLGGTPLKAPFSVRVTTLTSKRTLSARNVIPDHWYPNATYKARLNFED

SEQ ID NO: 344 - protein, 239 aa, Pinus radiata
MGALGFLVVGLLLVTTRATMASSWISAHATFYGGSDASGTMSGACGYGNLYSQGYGANTAALSTALFNNGLSCGACFQVMCNDDPQWCLRGSVVVTATNFCPPGGWCNPPLRHFDLSRPVFLKIAKYKAGVVPILYRRVPCHKKGGIRFTINGHSYFNLVLISNVGGAGDVHGVWIKGSRTGWQPMSRNWGQNWQSNSYLNGQSLSFKVTTSDGRSVTSYNVASVNWQFGQTFSGAQFH

SEQ ID NO: 345 - protein, 247 aa, Pinus radiata
MGFLAFIGLFVFNFLSMARFAHGWTNAHATFYGGGDASGTMGGACGYGNLYSQGYGTSTAALSTALFNNGLSCGACFAIRCNDDPQWCLPGAIVVTATNFCPPNNALPNNAGGWCNPPLQHFDLSEPVFQHIAKFRAGIVPVMYQRVPCHRSGGIRFTVNGHSYFNLVLITNVGGAGDVHAVSIKGSRTGWQPMSRNWGQNWQSNSYLNGQSLSFKVTTSDGRTVTSYNAAPSNWQFGQTFAGAQIR

SEQ ID NO: 346 - protein, 280 aa, Pinus radiata
MATRTPNFFLFCSLGFMLIVTVPSPVLSCSSCVYQSKLAYYAYSGAVNVGACGYGSFAAKLYGGNVGAASSDLYRNGVGCSACYQIRCTDPKLCNKSGTTIVVADFTQNNQTYFVVSRSTFSSLAIADKGSQLIKGGIIDIEYKRVPCQYKDQNLVVRVDGSSQYPHYLAVQFLYQGGQTDIVSVDVAQVGTSGWHYMTRNHGAVWEIQKPPGGALQFRFVVTSGYDGKWLWAKKAVLPSDWKSEGLYDSGIQISDVALENCNPCNENNSGWADSSWIYV

SEQ ID NO: 347 - protein, 250 aa, Pinus radiata
MATVKLATIFGLWWIASTAYALDYGWQSAHATFYGGSDASGTMGGACGYGNLYSQGYGTNTAALSTALFNNGATCGACYQMKCNQQSDPQWCLPGTVTVTATNLCPPNSALPNDNGGWCNPPLQHFDMAQPAFQQIAIYRSGIVPIMFRRVPCVRKGGVRFAINGHSYFNLVLITNVGGAGDVEAVSIKGSNTGWQAMSRNWGQNWQSNSYLNGQTLSFQVTTSDGRTITSYNVASANWQFGQTFEGLQF

SEQ ID NO: 348 - protein, 200 aa, Pinus radiata
MAPVKLATIFGLLWIVGTAYALDYGWQSAHATFYGGSDASGTMGGACGYGNLYSQGYGTNTAALSTALFNNGATCGACYQMKCNQQSDPQWCLPGTVTVTATNLCPPNCWNVNSNCRLRGQRRTWATMDSNSLPARISSQRPPRNHRSKPQNQPVSYRTTLQRKVVSVQRAPMQLGADNCPPSDAGMTSATDTHRKVSLG

SEQ ID NO: 349 - protein, 266 aa, Pinus radiata
MNSGRSLHSDHLFGCKMAPVKLVTMFSFLWVAGAAYALDSGWQSAHATFYGGSDASGTMGGACGYGNLYSQGYGTNTAALSTALFNNGATCGACYQMKCNHHSDPQWCLPGTVTVTATNLCPPNSALPNDNGGWCNPPLQHFDMAQPAFQHIAIYRSGIVPIIFRRVPCVRKGGVRFTINGHSYFNLVLITNVGGAGDVEAVSIKGSNTGWQAMSRNWGQNWQSNSYLNGQALSFQVTTSDGRTITSYNVAPANWQFGQTFEGLQF

SEQ ID NO: 350 - protein, 250 aa, Pinus radiata
MAPLKLATMFSFLWIAGTAYAQDSGWQSAHATFYGGSDASGTMGGACGYGNLYSQGYGTNTAALSTALFNNGATCGACYEMKCNDQSDSQWCLPGTVTVTATNLCPPNSALPNDNGGWCNPPLQHFDMAQPAFQQIAIYRSGIVPIMFRRIPCVREGGVRFTINGHSYFNLVLITNVGGAGDVEAVSIKGSNTGWQTMSRNWGQNWQSNSYLNGQTLSFQVTTSDGRIITSYNVAPANWQFGHTFEGLQF

SEQ ID NO: 351 - protein, 250 aa, Pinus radiata
MAPLKLATMFSFLWIAGTAYAQDSGWQSAHATFYGGSDASGTMGGACGYGNLYSQGYGTNTAALSTALFNNGATCGACYEMKCNDQSDSQWCLPGTVTVTATNLCPPNSALPNDNGGWCNPPLQHFDMAQPAFQQIAIYRSGIVPIMFRRIPCVREGGVRFTINGHSYFNLVLITNVGGAGDVEAVSIKGSNTGWQTMSRNWGQNWQSNSYLNGQTLSFQVSTSDGRIITSYNVAPANWQFGQTFEGVQF

SEQ ID NO: 352 - protein, 268 aa, Pinus radiata
MKRFRCMSPCKFSAWLVIGAVSVFLCVKASWALEEEELEWHPATATWYGSPDGDGSDGGACGYGNLVDVKPYRKRVGAVSPVLFKGGEGCGACYKVKCTDERMCAKRAVTFVVTDECPGGPCAFGKTHFDLSGSAFGRMAIADKTTTILNSGEIPVLYRRTLCEFPRKNVTFHVNEGSTAYWFSILIEYEDGDGDVGAVHLREADSDEWMAMQHSWGANWCLLGGPMKAPFSLRVTTLSSNRTLSARNIIPQNWYPTASYRSRLNFDR

SEQ ID NO: 353 - protein, 268 aa, Pinus radiata; identical to SEQ ID NO: 352

SEQ ID NO: 354 - protein, 264 aa, Pinus radiata
MQTRRGSWVAYLLLLLLLNLGWWKQLIIMPTSAAYANDGWKYAFATFYSESDALGTMAGACGFGDLYRQGYGVNTAALSSVLYNGGQACGACFELRCVEDPLYCHPGTSIVVTATNFCPPNYGLPGEDGGWCNPPRQHFVLPVTAFEKIAMWKIGTMNVQYRRVRCAKVGGMRFAINGKDFFLTVLISNVAGDGAVSGVKVKGSKTGWLSMGTNWGQNWHVNADYRGQALSFEVTTSDGKTVTSYNVAPSDWQFGHTYKGKQFS

SEQ ID NO: 355 - protein, 253 aa, Pinus radiata
MLTSGFVLVAVAIIFANKFVSAHDYNGGWYYAHATFYGGADASGTMQGACGYGNLYSQGYGTNTAALSTVLFNSGASCGSCFEIKCVDDPQWCLPGSPSIVVTATNFCPPNYALPNDNGGWCNPPREHFDMAMPAFEQIGIWKAGIVPVQYRRVACVKEGGMRFTINGNYYFYLILVTNVGGDGVVADVKVKGSNTGWLPLSRNWGQNWQCNTILKGQALSFRVTSSGGRTVTSYNVAPSHWQFGQTFEGNQF

SEQ ID NO: 356 - protein, 279 aa, Pinus radiata
MATQTPVVFVLYCILGVNLLIVFPSLALGCTSCVHQSKLAYYAYPGAVDVGACGYGSFAETLYGGNVGGSSRDLYRNGVACGACYQMRCTDSKLCTKSGTTIVVTDFTESSQTDFVVTRSTFSSMALPDHGDQLLKAGIIDIEYKRVPCQYKNQNMSVKVDKLSRYPNYLAVQFLYQGGQTDIVSVDVEQVGSSEKHDLKRNYGAVWDIENPPEGALQFGFVIVSGYNGKRVWPTKSVLPSDWKVGGVYDSGLQTNDVSLEKCSPCDHNDRGWGDSRIP

SEQ ID NO: 357 - protein, 256 aa, Pinus radiata
MISMTSMVRVKSVALVSMSTIIWLITRAHGYGDWESAHATFYGGSDASGTMGGACGYGNLNSQGYGTNTAALSTALFNDGLSCGACYEMQCNDDAQWCLPGTVTVTATNFCPPNNALPNDNGGWCNPPLQHFDMAEPAFQQIAKYKGGIVPILYRRVPCVRKGGIRFTVNGHSYFNLVLITNVGGPGDVHAVSIKGSRTGWQPMSRNWGQNWQSNSYLNGQSLSFQVTTSDGKTFVSYNAAPSSWQFGQTFEGCQV

SEQ ID NO: 358 - protein, 253 aa, Pinus radiata
MRSMELVKSIALASLLTFIWLLTGAHGYGGWESAHATFYGGSDASGTMGGACGYGNLYSQGYGTNTAALSTALFNDGLSCGACYEMRCNDDPQWCLPGTVTVTATNFCPPNNALPNDNGGWCNPPLQHFDMAEPAFLKIAKYRGGIVPILYTRVPCLRKGGIRFTVNGHSYFNLVLITNVGGAGDVHAVSIKGSRSGWQPMSRNWGQNWQSNSYLNGQSLSFQVTTSDGRTVVSNNVAPSNWQFGQTFEGSQV

SEQ ID NO: 359 - protein, 266 aa, Pinus radiata
MAIGIIERQAASLVKGFVIALVFSISVAEGSGYTSSGWTSGHATFYGGSDASGTMGGACGYGDLYSTGYGTKTAALSTALFNSGATCGACFQIQCDISKDPQWCLPGPKSITITATNFCPPNYALPSNDGGWCNPPLMHFDMAQPAWEQIAIYSGGIVPVQFRRVPCTPVGGVRFTINGRSYFELVLLSNVGGAGDISAVSIKGSNTGWQPMSRNWGVNWQSNSYLSGQSLSFQVTTSDGNSITFYNVAPSNWQFGQTFATSQQFN

SEQ ID NO: 360 - protein, 258 aa, Pinus radiata
MQSPLKSRVRYVLMVLAIIFAQTLAAADDCDGDWNSAHATLYGGGDAAGIMAGACGYGNLYSQGYGTNTAALSAILFDSGAACGACFEIKCVDDSQWCLPGSPSVVITATNFCPPNYALSNDNGGWCNPPREHFDMAMPAFEQIAIWKAGIVPVQYRRVRCAKGGGIRFTIHGNRYFYLILITNVGGDGDVAEVMVKGSNTDWLPLTRNWGQNWQSNTNLQGQALSFQVSSSSGHTITSYNVAPSDWQFGQTFQGNQF

SEQ ID NO: 361 - protein, 1024 aa, Pinus radiata
MFSTKFFAAAAATFSLIRFSTAVYDPSSQRNLAMYWGSGSDQLDLAHFCDETNVDIIPIGFINFFPPQANGLVAETFGDQCWDGNYTGPGYDGTNNPNDNFLYEQCPNLQRDLYYCQQNTNKKILLSLGGAVGNYYLNGPSDGEYLAEFLWGAYGPYNESWTGVRPLDRGYYNTNLTEHIDFDGFDFDIEQTTPDQQAGYIACIKRLRQLFIEHKAVNPCSKDYIISGAPQCPLDEPYMSTAIAGAQFDVLWIQFYNNGANGCTARNYTDSKALGKTSGFNYDSWVTKVNGGASAGAKLYIGLLAGQAASEFSPNDYIDGPAIQTLVSQYHSHPQFGGIMLYEATVAENNAQFYNTVKGILNDTALAGTVTSSAKVCSSTTSTSSKTSSTSTSTTSTSSKVTTTSSSTSSKASTTSSSSSTSSSSSTSSTSSSKTSSSSSSSSSTKTSTSSSVSSTSTTSSSSSSSSSSSLSSSSSSSSTSAYPTTSSSSVISSTTSASSTSSSSSSSSEISSSTSVSSTSSETPTSTPTPTTVPSVGSCTYLGCYTEATTTRALSGAVYDNYTLMSVEICAGFCTGFTYFGVEYGGECYCGNEFGEGSVVSPPIDCSMTCAGTPTELCGAGDRLDVYSCAGSATTTSSSVSGSSTSSIESSTSSSVSISSSSSVVSTSSSSVVSSTSSEVTPTTSSTSSSVSSTSSLSSTSVYSDSSSSVTSTSTSSLSSSSSVSETLTSTSSSSIYSPTITSTAYTNSSSAIVTPTSSLYTNSSSVITTSSSSSSSKSVCTRKTHTSSGSVSITSSYSVSGTATSISSYSVSSGSSSSSASGIISTPSSSLSGSATSSAQGTATSASTTQYTTSTVYTTSVHTITSCAATVTNCPARSTVLTTETIALYTTVCPVTATETGKGVPTTSSPVKPTSSGSGSGETTSYTTSTVYATSVYTITSCAPTVTNCPARIGSVTTETIALYTTVCPVTATETGKVAPSSTPSASSPVLPGKGGKSSSSAAGYPVSGTESVKHTTISSTT

SEQ ID NO: 362 - protein, 431 aa, Eucalyptus grandis
MAMAGSTGRRQQQLLLLALALSSLAAIASAAVLFEERFEDGWETRWVKSDWKKDENMAGEWNYTSGKWNGDSDDKGIQTSEDYRFYAISAEYPEFSNKDKTLVFQFSVKHEQKLDCGGGYMKLLSGDVDQKKFGGDTPYSIMFGPDICGYSTKKVHAILTYNGTNQLDQKGCSLTDQLTHVYTFVLRPDATYTILIDNVEKQTGSLYSDWDLLPPKQIKDPEAKKPEDWDDKEYIPDPEDKKPEGYDDIPKEIPDSDAKKPEDWDDEEDGEWTAPTIANPEYKGPWNPKKIKNPNYQGKWKAPMIDNPDFKDDPELYVFPKLKYVGIELWQVKSGTLFDNVLICDDPEYAKKVAEETWGKNKDAEKAAFDEAEKKREEEEAKDEPVDSDIEDEDDDADADDAEDDSDSVIKAEADESAESADSKDEVKDEL

SEQ ID NO: 363 - protein, 541 aa, Eucalyptus grandis
MMEGRRIRLLARALTVLLLSFQICASDVIFHESFDESFEGRWVVSEKEEYQGVWKHSKSEGHDDYGLLVSEKARKYAIVKELDDVVSLKDGTVVLQYEVRLQDGLECGGAYLKYLRPQDAGWKVKEFDNESPYTIMFGPDKCGATNKVHFIFKHKNPKTGEYVEHHLKHPASVPYDKLSHVYTAVLKPDNELRILIDGEEKKKANFLSAEDFEPALIPPKTIPDPDDKKPEDWDERAKIPDSDAVKPDDWDEDAPMEIVDEDAVKPEGWLDDEPEEIDDPEATKPEDWDDEEDGEWEAPKIDNPKCETAPGCGEWKRPTKSNPAYKGKWHAPLIDNPNYKGIWKPQEIPNPDYFELERPNFEPIAAIGIEIWTMQDGILFDNVLIASDEKVAESYRETAWKPKFEVEKEKQKEEDKATGSDGLSAIHKKVFDVLYKVADVSFLEPYKPKILELIEKAEEKPNIAIGVLGSIVVVILTVFFKILFGGKKPVANVPEPRREAAAETSNNQGSQGDKEDEDEKEDAGDAAAAAAPRKRPNRREI

SEQ ID NO: 364 - protein, 544 aa, Eucalyptus grandis
MEGSRIPRLVPALALVLISFAFLQIRASDVIFYDSFDQPFVGRWVVSVKDDYTGEWKHSKSEGHDDYGLLVSEKARKYAIVKELDEIVSLKDGTIALQYEVRLQNGLECGGAYLKYLRPQDAGWKVKEFDNDSPYTIMFGPDKCGSTNKVHFIFKHKNPKTGEYVEHHLKFPPSVPYDKLSHVYTAVLKPDNELRILIDGEEKKKANFLSAEDFEPPLIPPKTIPDPDDKKPEDWDEQEKIPDPDAVKPDDWDEDAPMEIVDEDAVKPEGWLDDEPEEIDDPEATKPEDWDDEEDGEWEAPKIDNPKCELAPGCGEWKRPMKRNPAYKGKWHAPLIDNPNYKGIWKPQEIPNPDYFELERPQFDPIAAIGIEIWTMQDGILFDNILIASDEKVAETYRETTWKPKFEVEKEKQKEEDKDSDSPGLSAVHKKAFDVLYMIADVPFLDPYKPKILDLIEKAEKQPNITIGVLVSIVVIILTLFFKILFGGKKPAVNVPEPRSEAAPETSDGPGSSGDKEDEDEDEDEDEKEETAAAPRRRSIRREA

SEQ ID NO: 365 - protein, 410 aa, Eucalyptus grandis
MKALLFLSFVLFVAVATATVHFQEEFDAGWEKRWVYSTADDASGSAGKFTATPGQYYGDAQKDSGVQTSTDARFYKASAQFPKFSNKDKPLVLQYSVKNEQELDCGGAYLKLSPPGVDQKSLTGETPYNIMFGPDVCGYSTRRVHFIFNYKGTNHLIKKTVAPSSDKLTHLYTAIINPDQTYEIRIDNEKKESGKLVDDWDFLPPKEINDPSISKPADWVEEKEIPDPEDKKPEGYDDIPKEIPDPDAKKPEDWDSELDGEWEPPTIPNPEYKGEWHPKLIPNPAYKGPWVHPQIPNPDYHYDDSIYAFEHEFVAFEIWQVKSGTIFDHILVTDSLEEAEAFATGHFAAQQKAEKAMYDKQEEEKQEKEKAEREAEKQKLEEEGKKEDDDEDEDEEEEEDEGKGHSHDEL

SEQ ID NO: 366 - protein, 434 aa, Eucalyptus grandis
MAGTERRQQLLFLLPTSPLCLALLLLLSSLARLALSEVIFEERFLDGWKRRWVVSDWKKSEGKAGTFKYTAGKWPGDPDDKGIQTIKDAAHSAISAKLPEFSNKNRTLVLQYSIKFEQEIECGGGYIKLLSGFVNQKKFGGDTPYSLMFGPDICGTQTKKLHVILSYQGQNYPIKKELECETGKLTHFYTFILRPDATYSILVDNRERDSGSMYTDWDILPPRRIKDVNAKKPADWDDREYIEDPNEVKPEGYDSIPSEIPDPKAKEPDNWDEEADGVWKPPKVPNPAFKGPWKRKKIKNPNYKGKWKIPWINNPEFEDDPDLYVMKPIQYVGIEVWQVKAGAIFDNVLICDDPEYAKQVVEEVFANREAEKEAFEEAEKVRKAQEEEEARRAREEGERRRRERGYDRRYRDRYRDKYRRHDRRDYMDDYHDEL

SEQ ID NO: 367 - protein, 811 aa, Eucalyptus grandis
MAAPKLGRIPSIRDRVEDTLAAHRNELVSLLSRYVAQGKGILQPHHLLDELENIISEDEGKSSLSDGPFSEVLKSAQEAIVLPPFVAIAVRPRPGVWEYVRVNVHELSVEQLTVSEYLGFKEELVDGKSEDSFVLELDFEPFNASFPRPNRSSSIGNGVQFLNRHLSSIMFRNKDCLEPLLNFLRAHKYKGHTLMLNDRIPSISRLQSALAKAEEYLSKLPTDTPYSEFEYMLQGLGFERGWGDTAERVLEMIHLLLDILQAPDPSTLETFLGRIPMVFNVVILSPHGYFGQANVLGLPDTGGQVVYILDQVRALENEMLLRIQKQGLDIAPKILIVTRLIPDSKGTTCNQRLERVSGTEHSHILRVPFRSDQGILRKWISRFDVWPYLETFALDAAHEITAELQGFPDFIIGNYSDGNLVASLLAYKMGVTQCTIAHALEKTKYPDSDIYWKKFDEKYHFSCQFTADLLAMNNADFIITSTYQEIAGTKNTVGQYESHTAFTLPGLYRVVHGIDVFDPKFNIVSPGADMCIYFPYSEKQKRLTALHGSIEKLLYDPEQNDEHIGSLSDRSKPMIFSMARLDKVKNMTGLVECYAKNSKLRELANLVVVAGYIDVKKSKDREEIAEIEKMHELMKEYNLDGQFRWMAAQTNRARNGELYRYIADTKGVFVQPAFYEAFGLTVVEAMTCGLPTFATCHGGPAEIIEHGVSGYHIDPYHPDQAATLLADFFEQSKRDPNHWTKISAAGLQRIYERYTWKIYSERLMTLAGVYGFWKYVSKLERRETRRYLEMFYILKFRELVKTVPVAADEPH

SEQ ID NO: 368 - protein, 811 aa, Eucalyptus grandis; identical to SEQ ID NO: 367

SEQ ID NO: 369 - protein, 805 aa, Eucalyptus grandis
MAERLLTRVHSLRERLDETLLAHRNDILAFLTRIEAKGKGILQHHQLIAEFEAISEEHRKKLSEGAFGEILRSSQEAIILPPWIALAVRPRPGVWEYIRVNIHALVVEELQVTEFLHFKEELVNGNLNGNFVLELDFEPFTAQFPRPTLSKSIGNGVEFLNRHLSAKLFHDKESLHPLLEFLQVHCYKGKNMMVNTRIQNVFSLQHVLRKAEEYLSALKPETPYSQFEHKFQEIGLERGWGDTAERVLEMIRLLLDLLEAPDPCTLENFLGRIPMVFNVVIMSPHGYFAQDDVLGYPDTGGQVVYILDQVRALESEMLHRIKQQGLDITPRILIVTRLLPDAVGTTCNQRLEKVFGTEYSHILRVPFRTEKGMVRKWISRFEVWPYLETYTEDVANEIAGELQGKPDLIIGNYSDGNIVASLLAHKLGVTQCTIAHALEKTKYPESDIYWKKFEEKYHFSCQFTADLIAMNHTDFIITSTFQEIAGSKDTVGQYESHTAFTLPGLYRVVHGIDVFDPKFNIVSPGADMSIYFSYTEEKLRLKSFHAEIEELLFSDVENKEHLCVLKDRNKPILFTMARLDRVKNLTGLVEWYGKNTRLRELVNLVVVGGDRRKESKDLEEQAEMKKMYGLIETYNLNGQFRWISSQMNRVRNGELYRYICDMRGAFVQPALYEAFGLTVVEAMTCGLPTFATCKGGPAEIIVHGKSGFHIDPYHGDQAAETLANFFEKCKVDPSHWDKISQGAMQRIKDKYTWQIYSERLLNLTAVYGFWKHVSNLDRLESRRYLEMFYALKYRKLAESVPLAVE

SEQ ID NO: 370 - protein, 838 aa, Eucalyptus grandis
MDSSPALKTTEPVPDSMPEAPSQSRYHMKRCFAKYMEKGRRIMKFHHLMDELESAIDAKTERELVLGSDLGYILCYTQEALVVPPHMAFAVRRSPGNWEYVKVSSDSLSVEGMSAADYLKFKAMIYDEEWAKDENALEVDFGALDFSVPHLTLSSSIGNGVDFISKYLSSKLSGTPDSAQPLVDFLASINYQGENLMINETLDTAPKLQMALIVAEASLASVPKDTPFQDFEMRFKEWGLEKGWGDTAEKVKDTIRWLSEVLQAPDPTNMEKFFSRLPMIFNVVIFSPHGYFGQSDVLGLPDTGGQVVYILDQVRALEEELLLRIKEQGINAKPQILVVTRLIPDARGTKCNQELEPIIGTKHSNILRVPFRTEKGVLRQWVSRFDIYPYLERFTQDATIKILDQLEGKPDLIIGNYSDGNLVASLMASKLGTTQGTIAHALEKTKYEHSDVKWKELDPKYHFSCQFIADTIAMNATDFIITSTFQEIAGSHDRPGQYESHAAFTLPGLCRVVSGINVFDPKFNIAAPGADQSVYFPYSEKQKRLTQLNRAIEELLYSRVDNDEHIGYLADKKKPIIFSMARLDTVKNITGLVEWYGKNARLRSLVNLVIVGGFFDSSKSKDREEMAEIRKMHDLIAKYKLKDQIRWIAAQTDRYRNGELYRWIADTRGAFVQPALYEAFGLTVIEAMNCGLPTIATNQGGPAEIIVDGVSGFHIDPNHGEESSNKIADFFEKCKVDNEYWNKISAGGLKRINECYTWKIYANKMLNMGCIYTFWRQLNKEQKQAKQRYIQMFYSLQLRNSMKTVPIKTDEPEQAAPKPPPKVQPTMSTRRTQSRIHK

SEQ ID NO: 371 - protein, 799 aa, Eucalyptus grandis
MADRVLNRSHSPRERLDEALFADRNDCLVFLSRLKAKGKGILQRHQILAVFEAIPEESRARLLDGAFGKVLKSTQEAIVSSPWVALAVRARPGVWEHIRVNVHALLLEHFQVDEYLHFKEALVDGSLNPDSEPLTATFGRPTLSTSIGNGVECIRRSLSDKLFPDKESLHPLLEFLQVHSYKGKNMMVNARVQNVSSLQPVLRQAEEYLNTLKPETPFPKFEHKLQEIGLEQGWGDTAEWVLDMIQDLLDLLMVPNPGALEKFLGRIPMVFDVVIVSPHGYFAQDNVLGYPDTGGQVIYILDQVRALETEMLHRIKQQGLDITPRILIITRLLPDAVGTTCGQRLEKVFRTKHSRILRIPFRDKKGIVSEWISRFKVWPYLERFAEDVAKELRGELQRNPDLIIGNYSDGNIVAYSLAKKLGVTQCTIAHALEKGKYPGSDIYWKKFDNEYHLSCQFTADLLTMNYTDFIIASTSEEIAGSKDTVGQYESYTNSTLPGLYRVVHGINVFDPKFNIVSPGADMSIYFPYTEQKRRLKSFHPEIKELLFSDVENKEHLCVLKDKNKPIIFTMARLDRVKNLTGLVEWYGKNPKLREVANLVVVGGDRRKDSKDLEEQSEMKTMYDLIEKYKLNGQFRWISSQTNQVRNGELYRYICDTKGVFVQPAIYEAFGLTVVEAMTCGLPTFATCNGGPAEIIVHGKSGYHIDPYHGDQAAELLVEFFEKCKVDKSHWDKISKGAMQRIEEKYTWKIYSERLLNLTAVYGFWKHVTSLDRRESRRYLEMFHALVYRPLAQSVPPAVE

SEQ ID NO: 372 - protein, 470 aa, Eucalyptus grandis
MAASFLSNPSSLSFLLLLLLLHASRLAFSQSFVGVNYGQVADNLPPPESTAKLLQSTTIGKVRLYGADPAIIKALANTGIGIVIGAANGDIPSLAADPNAAGQWVGANILPFYPASKITLVTVGNEVFMSNDENLMSQLLPAMQNMQRAITAAGLGGKVKVSSVHAMSLLSQSDPPSSGRFHPSFEARMRDVLQFQRENGSPLPINPYPFFAYQSDPRPETLAFCLFQPNAGRVDSGTGIKYMNMFDAQVDAVYSALKALGYKDIEIMVAETGWPYNGDSNEVGTSVENAKAYNGNLIAHLRSLVGTPLMPGKSVDTYIFALYDEDLKPGPTSERSFGMYKPDLTMTYDIGLAKSSQTPASPKAPVTPTPVTPTPKPTGPGWCVPKSGVSDAQLQASLDYACSNNIDCSPIQPGGACFDPNTIASHAAFAMNLYYQTLGRNPWNCDFSQTATLTTNNPSYNGCVYPGGST

SEQ ID NO: 373 - protein, 389 aa, Eucalyptus grandis
MASSSSLLRALFLLLSLSDSATQILGLEFGINYGQIADDLPSPSRVATLLGSLNVSRVKLYDADPNVLQAFSNSNVDFIIGIGNDNLQNMTILANAQDWIQQHVQPYIGQTQISCIVVGNEVLNSSNNQWMPYLVPAMKTVYSALSNLGLNKQVAVTTAHSLNILATSYPPSAGSFWPNLAQYLQPLLNFQAQINTPFLINAYPYFAYKGSPSEVSLNYVLFQPNEGLTDPVTNLHYDNMLYAQIDAVYSAIKAMGHTDITVRISETGWPSKGDDDEAGATLENAHIYNENLLQRIEQKQGTPAKPSVPIDIYVFALFNENLKPGPTSERNYGLYYPDGTPVYSLGLQGYLPELYSATGTRPGLYSATGTRVLPFSVVLVSIMTFLMNI

SEQ ID NO: 374 - protein, 421 aa, Eucalyptus grandis
MASSALPPSNLLLLLLLLLISGLACVAAMAAPIGVNYGQIANNLPSPDHAVTLVKSIGATRVKLYDADSRVLCAFAHTGVEFTVGLGNEFLVQMKDPKNALSWVKSNVQSFLPDTNITTIAVGNEVFTSNDTSLRDLLMPAMKNVHDALASLGLDKQVTVTTAHSLAILETSYPPSTGRFRRDVASRVSQVLDFQCQTGSSFLINAYPYFAYKANPKQVPLDFVLFQASQGITDPSTGLNYENMLFAQIDAVHSALAAVGYANMTVHVSETGWPSRGDDDEVGATPENAKKYNGNLIKIVKQKKGTPMKPNSDLNIYVFALFNENMKPGPMSERNYGLFKPDGTPSYTLSSGGGGGGGGGGTSNGTSSGGFGGGGGGGGSASDGTPPAPIGYLSVSSGANELRSLGAACLMLALFLIKLVF

SEQ ID NO: 375 - protein, 345 aa, Eucalyptus grandis
MAKSSPFAADSLSIPSMLLFALMVFTILHRTAAQTGVCYGMLGNNLPSAQEVVALYKQNNIPTMRIYDPNPQALQALGGSNIELVLGLANPDLQSIASSQANASAWVQNNIKNHGNVRFKYVAVGNEVKPSDSFAQFLVPAMRNIRTALAGAGLEQIKVSTSVDTGVLSESFPPSKGVFRSDYMPLLGPIIGLLVETQAPLLVNVYPYFSYIGDPQGIRLDYALFTAPSVVVTDGALGYQNLFDASLDAVYSALEKADGGSLKIVVSETGWPSAGGGEATTLDNARTYNTNLAKHVKGGTPRRPRGPIETYVFAMFDENQKSPETEKYWGLFLPNKQPKYSIDLN

SEQ ID NO: 376 - protein, 465 aa, Eucalyptus grandis
MANPHLPPLSLLLLLLLLGSAHGVSAVGVNYGTIGNNLLPPKKVAQLLQSTLIDRVKIYDSNPDILDAFSNTGIDLVVAVENPLVANLSKDPSAAAEWLASRVAPFLPATSVVSVAVGNEYLTSGDDKLEPNDVVQAMQNLHAALVARGLDRKIKVSTPHSMAVLAASFPPSSSTFAMTLLPTMTSIVQFLADTGAPFMINAYPYFAYRDNPSSVDLEYALLGNKTTVRDPKGYVYTNMLDAQIDAVRSAIGALGFGNRSIEITVSESGWPSKGEDGDKAATPENARTYNTRLIERAQANRGTPMRKEERVEIFVFALFNENKKEGGVAERNFGLFAGDGSKAYDVDLSCQFCSGGVSGFGEKAAGSSGVALRGPSVWCVAKPHAEEGVLQAVVDFCCGAGGVDCREVYEGGDCYAPEKVHAHASYAMNAYYQMHGRNYWNCDFKGTGLVTFGDPSYGRCRYSQQ

SEQ ID NO: 377 - protein, 466 aa, Eucalyptus grandis
MQMGLLHLLVFSSLLLALCSAEILSKVGVNYGQLGNNLPSPTRSVWLIKHQLKAQRVKIYDANPSILRALKHTGIQVSVMVPNELINAIAVNQTLADSWVGSNVVPFHPATKIRYLLVGNEILSSADNTTWFNLVPAMRKVKKALKRHKVHHKVKVGTPLAMDVLATSYPPSSGSFRPDVSDRVMKPMLQFLNRTKSFFFIDVYPYFAWSSDPKTIDLNYALFESKNVTVKDPGTGLVYTNLFDQMVDAVTFAMKKLGYPNIPIWIAETGWPNAGDYDQIGANIYNAATYNRNVVKKLSARPAIGTPARPGWVLPSFMFALYNENQKTGPGTERHFGLLYPNDSFVYDIDLSGETPDTEYGKLPAPTNNEPYEGKIWCVVAKRANRSALASALSYACSQGNATCGPIQPGKACHRKGSLVRQASYAFSSYWAQFRKTGGSCYFNGLATQTIEDPSYGSCEFPAVTL

SEQ ID NO: 378 - protein, 495 aa, Eucalyptus grandis
MMGERGLGRILLLLLPFLPIALGAFVGINIGTDVTNLPEASDIVAVLKSNEITHVRLYNADAHMLKALANSGINVMVGVTNEEVLGIGEYPATAAAWINKNVAAYLPATNITAIAVGSEVLTAIPHAAPVLVPAMNNLHKALVASNLNFVVKVSTPQSTDVIPKPFPPSAAAFNSSWNSTLYQLLQFLKNTNSSYMLNAYPYYGYTQGNGIFPLDYALFRSLPSVKQIVDPNTLFHYSSMFDAMVDATYYSIEAMNFSGIPVMVTETGWPWFGGSNEPDATAENAQTFNNNLIKRVLNGSGPPSQSDVPINTYIYELFNEDKRPGPVSEKNWGVFFTNGTSVYPLSLGTSGRITGNSSGIFCVAKQDADSDKLQDGLNWACGQGHANCAAIQEGQPCYSPNTVANHASYAYNDYYQKMQGVGGTCDFQGTAMTTTVDPSYGSCKFTGSSNSSSTVTTPVASAPFSPIGGGSPTSAVLASKLKYVICTISVVLTLL

SEQ ID NO: 379 - protein, 249 aa, Eucalyptus grandis
MGGKRVRYAIILLCHLLLCSGSGSLATRKEAVGYANEIAQGKKYPTSSPSGQKDITDPVTTVPTMNPAPFASADPVVNPTSNPELAPPAVISPITYPAMATPPPSLSSSWCIASQSVSQTALQVALDYACGYGGADCSGIQPGGSCYYPNTVHDHASYAFNKYYQKNPVPTSCSFGGTAVVTSTDPSTSTCQFQSTSTASSILNTTNSSGATVFGAVPSGPPASSASQLSCIVSLVMTLSWLSFASGIY

SEQ ID NO: 380 - protein, 527 aa, Eucalyptus grandis
MAISKLAPLLFLALVFLSIAEPGEPSLFADIKQGQDPDKEPYVGVNVGTDVSHLLSPPNLVSFLQVQKITHVRVYDADPDLLKALAKTKIRVIIGVPNNQLLAIGSSNATAASWVGRNVVAYYPETSIIGIAVGDEVLTTVPSSAPLLVPAIESLYSALVAANLHTQIKVSTPHAASIILDSFPPSQAYFNQSLVSVMLPLLQFLSRTGSPLMMNLYPYYVFMQNKGVVPLDNALFKPLTPAKEMVDPNTLLHYTNVLDAMIDATYVSMKNLNVTDVVVLVSESGWPSKGDSKEPYATVDNADTYNSNLIKHVLDRTGTPLHPELTSSVYIYELFNEDLRSPPMSEANWGLFYGNSTAVYLLHVSGSGGFLANDTTNQTYCIAMDNVDSRTLQTALDWACGQGQANCSEIQPGEDCYQPSNVKNHASYAFDSYYQKEGKAAGSCDFKGVAMITTTDPSHGSCIFPGSKKVSNATKQVVNSTVSSGATESSRFFIFSSNRRTAIDKALGSVFSVLFSFFLAVALWTPI

SEQ ID NO: 381 - protein, 474 aa, Eucalyptus grandis
MEHLPLAFFFLLLSVLSLADGGSIGVNYGRVADNLPPATKVVQLLKSQGVQKVKIYDADPAVLHAFAGTGIRLTVDLPNEKLFAAARSLSFSLDWVQQNVADYPTTQIEAIAVGNEVFVDTHNTTRFLVPAMKNIHTALVKHNLHNAIKISSPIALSALQASYPSSAGSFRPELIEPVFKPMLEFLRQTGSYLMVNAYPFFAYESNSDVISLDYALFRENPGVVDAGNGLRYFNLFDAQIDAVFAAMSALKYDDIKMVVTETGWPSKGDENEVGASKDNAAAYNGNLVRRILTGGGTPLRRQADLTVYLFALFNENKKPGPSSEQNYGLFYPNQDKVYDVPLTVEGLKNYHDTGKSAPAGGGQRGVAAPVKGGRGGVSKSSSANTWCVAKGEAGKEKLQAALDFACGEGGADCRPIQRGSTCYDPNTLEAHASYAFNSYYQMKGRAFWTCDFGGAASIVSQPPKYGKCDFPTGY

SEQ ID NO: 382 - protein, 476 aa, Eucalyptus grandis
MITEMSKIIPRMLSDSVFDIVFLLLSSSFFMQGARAGIGVNYGTVADNLPPPAQVAHFLLESTTIDRIRLFDADPDILKAFANTGIAVTVTVPNDLIPQLAKLSNAQDWVRTNVEPYVPATDIVRILVGNEVLATANRLLLGNLVMSMRMLHAALANASLDGRIKVSTPHSLGILSSSSPPSSGKFRLGYDVHILRPLLNFLRETGSPFLVNPYPFFGFSKDTLDYALFRPNAGVMDENSKLVYTNMLDGQLDAVYSAMKVLGFTDIEVVIAETGWPSLCDSTQVGVDAKTAAEYNSNLIRHVSSGAGTPLMPKRTFETYIFALFNENLKPGPTCERNFGLFRPDMTPVYDAGILRPTARSSVPIDPIPAPSSMTPPTSPASMSPPKGTQWCLPKTGADPDALQRNIDYVCGLGLECRPIEEGGACFLPNTVRAHAAYAMNAYYQAMGGNNYDCDFKGTGAVTAIDPSYGKCTYHG

SEQ ID NO: 383 - protein, 460 aa, Eucalyptus grandis
MANLFPLATAVFFLSVACPHLSRAAYTIGVNYGTVADNLPPPSQVATFLKTKTAIDRVKLFDANPDILRAFAGTGIAVTVTVGNGDIISLSKLPAAQAWVSANILPFHPKTLINRIAVGNEILATSDKNLIARLLPAMKALHSALQLVNVTNVQVTTPHSLGILSSSEPPSTGRFRRGYDRAIFAPILDFHRQTKSAFMVNPYPFFGFTAKTLNYALFKPNAGIFDAATGKNYTNMFDAQMDAVYSAMKKVGYEDVEIVVGETGWPSVGDANQPDVNMANAVSYNGNLVRHVNAGKGTPLMPNRKFETYVFALFNEDLKPSTSERNYGLFKPDLTPVYDVGILRNEPAGGPAPASPSPTAQPSPTAPPTSSGKKWCVPRSDASDQALQANIDYVCSAQVDCKPIQTGGACFDPNTVRSHAAYAMNAYYQSMGQHDYDCDFDKTGVVTAVDPSTSSSIPCF

SEQ ID NO: 384 - protein, 482 aa, Eucalyptus grandis
MLQPRTKVATFSLLLVLSSSFPAAEPAIGVNWGTISFHRLRPSTVVDLLQQNKIQKVKLFDADPGALKALEGSGIEVMVGIPNEMLTVLGSSSVASDLWVRQNVSSFVGKGGVAIRYVAVGNEPFLSSYAGQFQNYVMPALLNLQQSLAKANLAGYVKLVVPCNADAYEADLPSQGAFRPELTQIVTQLVSFLNSNGSPFVVNIYPFLSLYGSTDFPQDYAFFGGTTHAVTDGANVYTNAFDGNFDTLVAALTKLGYGQMPIVIGEVGWPTDGALNANLTAARAFNQGLINHVLSNRGTPLRPGVPPMDVYLFSLLDEGAKSVLPGNFERHWGIFSFDGQAKYALNLGLGNRLLKDARNVQYLPSRWCVADPSKDLSAVMNHMKLACSVADCTTLNYGGSCNGIGAKGNISYAFNSYYQLQMQNSQSCDFDGLGMVTFLDPSVGECRFLVGVTESTSAAVETYWRGVIVWVLVMWSVWVFEV

SEQ ID NO: 385 - protein, 474 aa, Eucalyptus grandis
MAIPPLATLVLLVVLSQASCFANSQSFIGVNYGQVADNLPQPSATAKLLQSTSIEKVRLYGTDPAIIGVLANTGIGIVIGAANGDIPALANDPNFAKNWVNANVVPFYPSSKIILITVGNEVMTSGDHNLMTQLLPAMQNMQNALNAVSLGGKIKVSSVHSMAVLKSSEPPSSGSFDPSDEMKGILGFNNATGSPFAINPYPYFAYRSDPRPETLAFCLFQPNAGRLDTKTQIKYTNMFDAQVDAVRSALNSFGYKNVEIVVAETGWPYKGDSNEVGPSIENAKAYNGNLIAHLRSLVGTPLMPGISVDTYLFALYDEDLKPGPTSERAFGLFKSDLSMNYDIGLSKSSQTPAAPKMPAAPSPNATVTPSPNATVTPSPKPDKANWCIPKSGVSDAQLQANLDYACGQGIDCRPIQPGGACFEPNTLAAHAAYAMNLYYQNSNRSPTNCDFSQSATFSSNNPSYNGCVYPSGKS

SEQ ID NO: 386 - protein, 489 aa, Eucalyptus grandis
MAESISHYPFPTLGLIVLCFMTMFSIGSSVGVNWGTQSNHQLPPEKVVKMLKENGIKKLKLFEYDEKILGALAGSKIEVMLAVPNYMLEIMSVDPSFAASWVDTNVTSYRYTGGVNIKYIAVGNEPFLQSYNHKYVRQVLPALRNIHEALHRARLSSKVKVTVPFNADVYYSPPPNEYPSSGDFRPEVRDAAIEIIHFLYINDSPFTVNIYPFLSLYQNQNFPVDFAFFDGTTEPVKDGDRVYTNVFDANFDILVSALTKAGYSDMEIIVGEIGWPTDGDKFANIKNAQRFNQGLLKHALSGDGTPARKGVINVYLFSLIDEDTKNIDPGNFERHWGLFEYDGKPKYELDLSGSEKDTRLVPVMGVSYMPRRWCILNPELNDLTDLGENIDYACKSSDCTALGYGSSCNNLSSQGNASYAFNRYYQMNDQRIMACDFQGLAVVTENDPSTEGCQFPLMIASGDSMSWNQGLLHTSFRFYLWFLVFWVIL

SEQ ID NO: 387 - protein, 481 aa, Eucalyptus grandis
MEKFDLFKWVLCGSIVLFGVGCGRVDGLGVNWGTLATRKLPPKTVVQMLKDNGIQKVKLFDADRKTMSALAGSGIEVMVAIPNDQLAVMGSYDRAQEWVKKNVTAYNFTGGVNVKYVAVGNEPFLKSYNGSFVNTTLPALQNIQKALNEAGLGDTVKATVPLNADVYESPEDNPLPSAGTFRSDISDVMTQIVKFMAENNAPFTVNIYPFLSLYGNNDFPFNYAFFDGATPIVDKGIEYTNVFDANFDTLVSALKAVGHGNMTIIIGEVGWPTEGDINANNGNAYRFYNGLFTKLGANRGTPLRPGYIEVYLFGLIDEDAKSVAPGNFERHWGLFRYDGQPKFLIDLTGRGQNKLLIPAQNVEYQPQKWCTFNAGAKDVSKLVDNINFACTYADCTTLGYGSSCNSLDANGNASYAFNAYFQTQNQDPDSCNFQGLATVTTKNISQGSCNFTIQLVASSTSILRPLIVLTVISMAYTFLLQ

SEQ ID NO: 388 - protein, 361 aa, Eucalyptus grandis
MASLFPLTAAVVFLSVACPHLSRAAYTIGINYGTIADNLPPPSKVATFLKTKTTIDRVKIFHASPDILRAFAGTGIAVTVSVGNEDIVSLSKLPAAKSWVSANILPFYPKTLINRIAMGNEILATSDKTLIANLLPAMKALHSALQLANVTNVQVTTPNSLGILASSYPPSNGSFRSGFDRTIFAPILKFHRQTNSSFMVNPYPFFAITPENVNSLLNYSLFKPIPSSTFDAATGKNYTNMFDAQMDAVYSAMKKVGYEDVEIVVGETGWPSVGDPNQPGVSMANAESYNSNLVRHVNSGKGTPLMPNRKFETYIFALFNENKKPSTSERNYGLFKPDLTPVYDVGILRNSVNAVPLHLLG

SEQ ID NO: 389 - protein, 931 aa, Eucalyptus grandis
MRRVCACFLTSPAKTPPKHGTQRVSKQTAGNQKSESASNNSEVMANSSGSQGTNIIQNHNFSGGLHSWHPNCCESWVVSAESGDCYAMVTNRKECWQGLEQDITSRVTPGSTYSVSACVGVSGSLQGSADVLATLRLEHQDSAATYKRIGITSVSKERWDKVEGSFSLSSMPNRVVFYLEGPSSGIDLLIKSVVITCQSANGKERVDREHIAAGDENIILNPIFDDGLKNWAGRGCKIVLHDSMADGKIVPQSGKYFVSATERTQTWNGIQQEVTGRLQRKLAYEVTALVRIFGNNVSSTDVRITLWTQTPDLREQYIGVANVQATDKDWTQMQGKFLLNGSPSKVIIYIEGPPAGTDILVNSLTVKHAAKAAPSPPPVIQNPAFGVNIIGNSDLDNGTNEWFPLGNCTLSVRAGSPHILPSSARDSLGPHEPLSGSYILVTNRTQTWMGPAQMITDKLKLFLTYQVSAWVRIGSGASGPQNINVALGVDNQWVNGGQVEANDDRWHELSGSFRIEKQPSKVMVYIQGPAPGVDLMVAGVQIFPVDRQARFNHLKHLTDKLRKRDVVLKFSGADSSSLVGATVIVKQTQNSFPFGSCISRTNIDNEDFVDFFVKNFNWTVFGNELKWYWTEPQQGNFNYRDADEMLDLCKSHGIETRGHCIFWEVESTVQAWVQSLNNNDLMSAVQNRLNGLLSRYKGKFSHYDVNNEMLHGSFYQGRLGKDIRANMFKTANQLDPSATLFVNDYHVEDGCDTKSCPEGYIEHILGLQEQGAPVGGIGIQGHIDNPVGPIINSALDKLGILGLPIWFTELDVSSVNEYVRADDLEVMLREAFAHPAVDGIMLWGFWELFMSRDNAHLVNAEGDVNEAGKRYLALRKEWSSHAHGHVNEQGEYTFRGFHGTYDVLIVTSSKRTTKSIVVDKGESPLVVPISL

SEQ ID NO: 390 - protein, 607 aa, Eucalyptus grandis
MTMILPGFSRTAPIAGAMRTSPGFNMFLFLSLAFALLSLGSAISGQIMQTVFDDYYDSSATTQCLAEPGSLMYGGGVILNPEFIHGTSGWTVLGEGATEVRISHTNNRFMVARDRKRPTDSFSQKVQLEKGMFYAFSAWVQASQGSETVAVVFRTRDGKFVRGGSVVAKQGCWSLLKGGIAANSSSPADVLFESKNTSTEIWVDNVALQSFSKKQWRTHQEESIEKVTRKRKSTVRFQITSANERGLGVGGANVLIKQIKPGFPFGCGMNFHILESADYQNWFASRFRYATFTNAMKWYSTEKEQGQEDYSVADAMLKFVQDNNISIRGHNVFWDDPKYQPDWVRTLSPDDLRKAAEKRINSVVSRYAGELIAWDVVNENLHFSFFEDNLGENASSMYYSMAYKLDPTPRMFLNEYNTIEYSGDEKVSPGNYKKRFQEIFTYPGNEDIPAGIGVQGHFGAGQPNSAYMRSGLDILATTGLPIWLTEVSVAPGANQQYLEEVLREAYSHPGVEGIIMFAGPAYAGFNSTALADMNFDNTPTGDVVDQLIQEWRFKDLAARADDEGFFSTKLLHGEYEITITDPISNSSSTSRFQVTKDSFKIIYHFHM

SEQ ID NO: 391 - protein, 549 aa, Eucalyptus grandis
MKDASAFISFLVFFLLLCSPWIAASLDDPQYDHTAYTKCKEEPEKPLYNGGILEPHQLPQFASSSPALLLHNLTASTKYSFSSWVKIESSDSDSALVTASLRTNHETYDCIGTVAAKSGCWSFLKGGFTLDLPSNSATLSFESSDGRYIAIAISSTSLQPFTDQQWRRNQQDMINKVRKRAVMIHVSNHNGDRLQGVEINVKQVYKDFPFGSAIAKTILGNEAYQNWFVERFNAAVFENELKWYATEPYPGQINYTIADEMLEFIRANRIVTRGHNIFWEDPKYNPEWVQNLSGPQLESAVDTRIQSLMSRYREEFVHWDVSNEMLHFDFYERRLGPNATLHFFQTAHESDPLATLFMNEFNVLETCSDANSTVDSYISRMRDLKRGGVSMDGIGLEGHFTVPNLPLMRAILDKLGTLRLPMWLTEVDISSTLSKESQALHLEEVLREGFSHPSLNGIMLWTALHPNGCYQMCLTDADFRNLPAGDVADSLLGEWRTKEVNGKTNEHGSYSFEGFLGEYEVSVMHGDQTANSTFALSQGVETRHVTILL

SEQ ID NO: 392 - protein, 790 aa, Eucalyptus grandis
MMTPAQNRAPKVSSVLLCLCCIHAFFSCAVRLVAGQTPKPVFACDVDGNPSLAAFGFCNTSWGVEARVADLVQRLTLQEKVGFLVSGAGNVDRLGIPKYEWWSEALHGVSYVGPGTKFSSLVPGATSFPQVILTAASFNATLFETIGKVVSTEARAMHNVGLAGLTFWSPNVNIFRDPRWGRGQETPGEDPLLSSKYASGYVRGLQKSDDGNADRLKVAACCKHYTAYDVDNWKGVNRLTFNAVVTQQDLDDTFQPPFKSCVLDGNVASVMCSYNQVNGKPTCADPDLLAGTIRGKWKLNGYIVSDCDSVEVLYDKQHYTKTPEEAAAKAILAGLDLNCGSFLGQHTEAAVKGGLLNESAVDKAISNNFATLMRLGFFDGDPRKQLYGKLGPDDVCTPSNQELAREAARQGIVLLKNTAGSLPLSSTAIKSLAVIGPNANVTKTMIGNYEGTPCKYVTPLQGLAAIVSTMYVAGCADVGCSTAQTDDAKKAAASADATVLVMGADQSIEREDFDRVNLNLPGQQSLLVSEVANVSKGPVVLVIMSGGGMDVSFAKDNAKITSILWVGYPGEAGGAAMADVIFGDHNPSGRLPMTWYPQSYVDAVPMTNMNMRPDPATGYPGRTYRFYTGPTVYSFGDGLSYSSFSHGQVQVPQLVSVPLDEGHICHSSACESLEAKSETCSNLVFDVHLNVKNVGRFSGSHTVFLFSSPPSVHRSPQKHLLGFEKVFLASQSEAQVQFKVDVCKDLSVVDELGGRKVALGTHVLHVGDLKHALSVQIGSSGLSLSPPRHF

SEQ ID NO: 393 - protein, 790 aa, Eucalyptus grandis
MMTPAQNRAPKVSSVLLCLCCIHAFFSCAVRLVAGQTPKPVFACDVDGNPSLAAFGFCNTSWGVEARVADLVQRLTLQEKVGFLVSGAGNVDRLGIPKYEWWSEALHGVSYVGPGTKFSSLVPGATSFPQVILTAASFNATLFETIGKVVSTEARAMHNVGLAGLTFWSPNVNIFRDPRWGRGQETPGEDPLLSSKYAAGYVRGLQKSDDGNADRLKVAACCKHYTAYDVDNWKGVNRLTFNAVVTQQDLDDTFQPPFKSCVLDGNVASVMCSYNQVNGKPTCADPDLLAGTIRGKWKLNGYIVSDCDSVEVLYDKQHYTKTPEEAAAKAILAGLDLNCGSFLGQHTEAAVKGGLLNESAVDKAISNNFATLMRLGFFDGDPRKQLYGKLGPDDVCTPSNQELAREAARQGIVLLKNTAGSLPLSSTAIKSLAVIGPNANVTKTMIGNYEGTPCKYVTPLQGLAAIVSTMYVAGCADVGCSTAQTDDAKKAAASADATVLVMGADQSIEREDFDRVNLNLPGQQSLLVSEVANVSKGPVVLVIMSGGGMDVSFAKDNAKITSILWVGYPGEAGGAAMADVIFGDHNPSGRLPMTWYPQSYVDAVPMTNMNMRPDPATGYPGRTYRFYTGPTVYSFGDGLSYSSVSHGQVQAPQLVSVPLDEGHICHSSACESLEAKSETCSNLVFDVHLNVKNVGRFSGSHTVFLFSSPPSVHRSPQKHLLGFEKVFLASQSEAQVQFKVDVCKDLSVVDELGGRKVALGTHVLHVGDLKHALSVQIGSSGLSLSPPRHF

SEQ ID NO: 394 - protein, 784 aa, Eucalyptus grandis
  MOD_RES (2): variable amino acid
MXGTALPAAAAGTATLLLLLLISGGIGRLAVGAREPFACDPKDERTRGFPFCQASSPVPERARDLVGRLTLQEKAKLLGNDAAAVPRLGIKGYEWWSEALHGVSNVGPGTRFGGDFPGATSFPQVITTAASFNASLWEAIGQVVSDEARAMYNGGMGGLTYWSPNINILRDPRWGRGQETPGEDPVVVGQYAASYVRGLQGADGNGGGRLKVAACCKHFTAYDLDNWNGVDRYHFNARVSKQDMEDTFSVPFRMCVMEGKVASVMCSYNQVNGIPTCADPNLLRKTVRGAWRLDGYVVSDCDSVGVFYGNQHYTSTPQQAVADAIKAGLDLDCGPFLGKHTEEAVRGGLMNEADIDGALLNTLAVQMRLGMFDGEPSAQPYGTLGPKDVCTPAHQELALEAARQGIVLLKNQGPALPLSPRRHRAVAIIGPNSDVTVTMIGNYAGVACGYTTPLQGIGKYTKTIHQQGCADVACSDDKLFEGAIKAARGADATVLVMGLDQSIEAEFKDRDSLLLPGRQQELVSKVAMASKGPTVLVLMSGGPVDISFAKNDPRVAAILWAGYPGQAGGTAIADILFGATNPGGKLPMTWYPQDYLASVPMTVMDMRPTRSNLYPGRTYRFYGGPVVYPFGHGLSYTHFVHTLASAPSTVVVPLAGRRPANATMGPGKAVRVTHARCARLSLRVQLDVQNAGARDGAHTVLVFSTPPEDGGARWAPPRSQLVGFQRVHVAAGARERVGINIHVCKSLSVVDGAGVRRIPMGEHRLQIGDVVHSVSLQAEPLRVI

SEQ ID NO: 395 - protein, 780 aa, Eucalyptus grandis
MRNRQVQILSLLITFASAATLLSTPAAAQPPPFSCDPSSPSTKSFPFCKASLPISKRAQDLVSRLTLDEKISQLVSSTPAIPRLGVPAYEWWSESLHGVSNAGRGIHFDGTIKSATSFPQVILTAASFDADLWYRIGQVIGTEARAVYNAGQATGMTFWAPNINIFRDPRWGRGQETPGEDPLVTGKYAVSYVRGVQGDRPQGGGKSRGGLQASACCKHFTAYDLDRWKGVDRYDFDAQVTAQDMADTFQPPFQKCIQDGKASGIMCAYNRVNGVPSCADYNLLSNIARRQWSFHGYITSDCDAVSIMYDNQKYAKTPEDAVADALKAGMDVNCGTYLQNHTKSAVEQRKVSVSEIDRALHNLFSVRMRLGLFNGDPKKQPFGNIGPDQVCSQKHQDLALEAARSGIVLLKNKEKHLPLQRSKSASLAVIGPNANKASNLLGNYAGPPCKSVTLLQALQSYVKDTRYQPGCDDVVCSSPQIAQAVEVAKAADHVVLIMGLDQTQEREDFDRVDLVLPGRQQEFITTVAQAAKKPVILVILCGGPVDIRFARDDQNIGSILWAGYPGEAGGMALSEIIFGEHNPGGRLPVTWYPQEFTRVPMTDMRMRPEPSTGYPGRTYRFYQGQSIFEYGHGLSYTEYSYKFISVTRELFYLSQSAKSQPDEASDASPRYRLVSDLGADFCKKSNFVATVKVKNHGDMVGKHPVLLFVRHAKPSSGSPMKQLVAFQSVELKGGETMKVQLALNPCDHLSRANENGVMILEEGWRFLEVGDQEYPINVMA

SEQ ID NO: 396 - protein, 637 aa, Eucalyptus grandis
MSVMGRYSVPIKAFLLICCLAAVTTEAEYVKYRDAKQPMGARVRDLMRRMTLAEKIGQMTQIERSVATPDVMKNYFIGSVLSGGGSVPAPKASPETWVNAVNEIQKAALSTRLGIPMIYGIDAVHGHNNVYNATIFPHNVGLGVTRDPVLLKKIGDATALEVRATGIPYAFAPCIAVCRDPRWGRCYESYSEDHRIVRMLTEIIPGLQGDLPANSPKGVPFVAGKNKVAACAKHFVGDGGTTKGINENNTVVDYNGLLSIHMPAYLDAIRKGVATVMVSYSSWNGKKMHANGDLVTGFLKNKLKFKGFVISDWEGIDRITSPPHANYSYSVQAGVGAGIDMVMVPYKVTEFLDDLTKQVQNNVIPMSRIDDAVKRILRVKFVMGLFDNPLADNSLANQVGSPEHRELAREAVRKSLVLLKNGKSSGKPLIPLPKKAQKILVAGSHADNLGNQCGGWTIAWQGLNGNDLTTGTTILNAVKSTVHPDTQVVYNENPDANFVKSNNFAYAIVVVGEPPYAETFGDSLNLTIPEPGPSTIRNVCGSVKCVVVVISGRPVVIEPYVSNIDALVAAWLPGTEGQGVADLLFGDYGFTGKLARTWFRSVDQLPMNVGDPHYDPLYPFGFGLTTKGTKESDPTYS

SEQ ID NO: 397 - protein, 501 aa, Eucalyptus grandis
MAHCRHHPLVLLCSLFVFLPSILAQTADFNLPLRAINLGNWLVTEGWMMPSRFDGLIGQLLDGAQVQFKSTQLKKFLCAEGANIVINRDRAAGWETFRLWRISDTKFNIRAFNKNFVGLKDKKIVIAEVYGTPSASETFEIIRNPNRPNRVRLRASNELFLQAKTLTSVTADYNGDTNWNDNDPSIFDINIVGGLQGEYQITNGYGPSTAPQLLRDHWNNYITEQDFRFMATNNVTAVRIPVGWWIAYDPTPPKPFVGGSLYALDRAFTWAENYRMKVIVDLHAAPGSQNAESHSATRDGFVEWGDSYIQETVKVIEFLAARYCNRSALVAIELMNEPRAPDVKLNDLIDYYRLGYEAVRRYTMDAYVILSNRLGPADPLELFQFVRGLSRVVIDVHYYNLYDPKFKQWNLQQNIGYIYVDRENDLSKITQKRGPLSFVGEWTSALDFDGATKEDSGRFAKAQQDVYRQATFGWAYRSYKCHYDTWSLEQMIEDGLIKIVA

SEQ ID NO: 398 - protein, 617 aa, Eucalyptus grandis
MGSAEDARCVYKDPNAAIEDRVNDLLSRMTLQEKVGQMTQIERRVATPSVLSGLSIGSILSAGGSGPFGVIGSESSKQALSSDWADMVDGFQKAALESRLGIPLIYGIDAVHGNNSIYGATIFPHNIGLGATRDAELVRRIGVATALEVRASGIPYTFAPCVAVLKDPRWGRSYESYSEDTDIVRKMTPIVAGLQGQPPQGHPKGYPFVAGRNNVIACAKHFVGDGGTERGVNEGNTVTSYEDLERIHMAPYLDCISQGVCTVMASYSSWNGRRLHSDYFLLTEVLKDKLGFKGFVISDWEGLDRLSQPHGSNYRQSISLAVNAGIDMIMVPFRHEQFAEDLTALAESGEVPMSRIDDAVQRILRVKFVSGLFEHPFSDRSLLQIVGCKSHRELAREAVRKSLVLLKNGKDPMKPFLPLDKNAKKILVAGSHADDLGYQCGGWTATWHGSSGRITIGTTILDAIKEAVGGNTEVIYEQNPSPSTLASHDYTFAIVAVGEGPYAETLGDNPELAIPFNGTDVIKSVAERIPTLVLVVSGRPLVIEPHVLEKIDALVAAWLPGSEGTGITDVVFGDYDFEGQLPISWFRTVEQVPMDHKANSYDPLFPLGFGLKCKKEA

SEQ ID NO: 399 - protein, 617 aa, Eucalyptus grandis
MGSAEDARCVYKDPNAAIEDRVNDLLSRMTLQEKVGQMTQIERRVATPSVLSGLSIGSVLSGGGSGPLGLAESASSERALLSDWTDMVDGFQKAALESRLGIPLIYGIDAVHGNNNIYGATIFPHNIGLGATRDAELVRRIGVATALEVRASGIPYTFAPCVAVLKDPRWGRSYESYSEDTDIVKKMTAIVTGLQGQPPQGHPKGYPFVAGRNNVIACAKHFVGDGGTERGVNEGNTVTSYEDLERIHMAPYLDCISQGVCTVMASYSSCNGRRLHTDYFLLTEVLKNKLGFKGFVISDWEGLDRLSQPHGSNYRQSISLAVNAGIDMIMVPFRHEQFAEDLIALAESGEVPISRIDDAVQRILRVKFVSGLFEHPFSDRSLLQIVGCKSHRELAREAVRKSLVLLKNGKEPTKPFLPLDKNAKKILVAGSHADDLGYQCGGWTVAWHGSSGRITIGTTILDAIKEAVGGNTEVIYEQNPSPSTLASHDYTFAIVAVGEGPYAETLGDNAELAIPFNGTDVIKSVAERIPTLVLVVSGRPLVIEPHVLEKIDALVAAWLPGSEGTGITDVVFGDYDFEGQLPVSWFRTVEQLPMDHKANSYDPLFPLGFGLKCKKEA

SEQ ID NO: 400 - protein, 618 aa, Eucalyptus grandis
MGSAEDARCVYKDPNAAIEDRVNDLLSRMTLQEKVGQMTQIERRVATPSVLSGLSIGSVLSGGGSGPLGLAESASSERALLSDWTDMVDGFQKAALESRLGIPLIYGIDAVHGNNNIYGATIFPHNIGLGATRDAELVRRIGVATALEVRASGIPYTFAPCVAVLKDPRWGRSYESYSEDTDIVKKMTAIVTGLQGQPPQGHPKGYPFVAGRNNVIACAKHFVGDGGTERGVNEGNTVTSYEDLERIHMAPYLDCISQGVCTVMASYSSWNGRRLHTDYFLLTEVLKNKLGFKGFVISDWEGLDRLSQPHGSNCRQSISLAVNAGIDMIMVPFRHEQFAEDLIALAESGEVPISRIDDAVQRILRVKFVSGLFEHPFSDRSLLQIVGCKSHRELAREAVRKSLVLLKNGKEPMKPFLPLDKNAKKILVAGSHADDLGYQCGGWTVAWHGSSGRITIGTTILDAIKEAVGGNTEVIYEQNPSPSTLASHDYTFAIVAVGEGPYAETLGDNPELAIPFNGTDVIKSVAERIPTLVLVVSGRPLVIEPHVLEKIDALVAAWLPGSEGTGITDVVFGDYDFEGQLPISWFRTVEQVPMDHKANSYDPLFPLGFGLKCKKEAR

SEQ ID NO: 401 - protein, 631 aa, Eucalyptus grandis
MKKNGESSHLYGGILVLCCFSGVTRAEYLKYKDPKQPLNTRINDLLSRMSLEEKIGQMTQIERSVASFEVMKKYYIGSVLSGGGSVPAPQASAETWIDMVNDFQNGSLSTRLGIPMIYGIDAVHGHNNVYRATIFPHNVGLGATRDPALVKRIGAATALEVRATGIPYVFAPCIAVCRDPRWGRCYESYSEDPKIVQAMTEIIPGLQGDLPAGSRKGVPYVAGKKNVAACSKHYVGDGGTTNGVNENNTVTDWHGLLGIHMPGYYTSIIKGVSTVMVSYSSWNGVKMHANGNLVTGFLKNKLRFRGFVISDWEGIDRITSPPHANYSYSIQAGISAGIDMVMVPSNFTEFIDGLTFQVKNKIIPMSRIDDAVRRILRVKFTMGLFEDPLADTSLVNQLGSQEHRELAREAVRRSLVLLKNGEGADAPLLPLPKKAPKILVAGSHADNLGYQCGGWTIQWQGLSGNNLTSGTTILSAIKNTVDPKTKVVYEENPDTDTVKSGKFSYAIVVVGEHPYAETFGDSSNLTIADPGTSTIGNVCGAVKCVVVIISGRPVVIQPYVAVMDAIVAAWLPGTEGQGVADVLFGDYGFTGKLPRTWFKTVDQLPLNVGDPHYDPLFPFGFGLTTAPVKRN

SEQ ID NO: 402 - protein, 669 aa, Eucalyptus grandis
MGGAFLRTLGVLTLWWFVASVMAQSADYVAYKDPKQPVAARVKDLLSRMTLEEKIGQMTQIDRMVATDDFMKTYSIGSVLSGGGSTPLPEASAEDWVNMINGYQKGALSSRLGIPMIYGIDAVHGHNNVYNATIFPHNIGLGATRDPKLVKKIGAATALEVRATGIPYVFAPCIAVCRDPRWGRCYESYSENEDIVRQMTEIIPGLQGDIPSGSRKGVPYVDGKNKVAACAKHFVGDGGTSKGINEDNTVVDMHGLLSIHMPAYTDAIIKGVSTVMVSYSSWNGEKMHANRDLVTGFLKNTLKFKGFVISDWQGIDRITSPPHANYTYSVEAGILAGIDMVMVPFNFTEFINDLTYLVKEKVIPMDRIDDAVGRILFVKFTMGLFENPLADLSLVNELGSQAHRELAREAVRNSLVLLKNGKNETDPLLPLPKKPKKILVAGSHADNLGYQCGGWTITWQGFSGNNYTRGTTILSAINSTVDLSTEVVYQENPDKDFVKSTDFDYAIVVVGEHPYAETAGDSTTLTMADPGPTTITNVCEAMKCVVIVVSGRPLVIEPYISSIDALVAAWLPGTEGQGVADVLFGDYGFSGKLPRTWFKSVDQLPMNFGDLHYDPLFPFDFGLKTESVPGLVARATSHGADGGPRLLMVTACLAISLYVTGYRWRASKF

SEQ ID NO: 403 - protein, 456 aa, Eucalyptus grandis
MASPAFSCLLLLVSIFALAESGSVGLNWGRVANDLPPPAKVVELLKSQGITLVKLYDTYDGALTALAGSGISVVVALPNEQLSSAASAQSFTDSWVQSNISKYYPSTKIVAIAVGNEVFVDPNNTTDFLVPAMNNVHASLVKYNLSDISVSSPIALSALQTSYPTSSGSFKSDLVEPVIKPMLEFLRKTGSYLMVNVYPFFAYTANSDQISLDYALLKQNPGVVDSGNGLKYNSLFDAQVDAVYAAMSALQYNDLKLVVTETGWPSKGDANEVGAGTQNAAAYNGNLVRRALTGTGTPLRPNNTVDVYLFALFNENQKTGPTSERNYGLFYPDEQKVYSIPLTLEQLASDPNNASKAQVPTAPVGQTWCVANGKAGEKKLQAALDYACGKGGADCQPIQQGSACYNPNTLEAHASYAFNSYYQKNARGAGTCNFGGAAFVVTQVPEYGECDFPTGY

SEQ ID NO: 404 - protein, 459 aa, Eucalyptus grandis
MAASFLSNPSSLSFLLLLLLLHASRLAFSQSFVGVNYGQVADNLPPPESTAKLLQSTTIGKVRLYGADPAIIKALANTGIGIVIGAANGDIPSLAADPNAAGQWVGANILPFYPASKITLVTVGNEVFMSNDENLMSQLLPAMQNMQKAITAAGLGGKVKVSSVHAMSLLSQSDPPSSGRFHPSFEARMRDVLQFQRENGSPLPINPYPFFAYQSDPRPETLAFCLFQPNAGRVDSGTGIKYMNMFDAQVDAVYSALKALGYKDIEIVVAETGWPYNGDSNEVGPSVENAKAYNGNLIAHLRSLVGTPLMPGKSVDTYIFALYDEDLKTGPTSERSFGMYKPDLTMSYDIGLAKSSQTPVTPTPKPTGPGWCVPKSGVSDAQLQASLDYACSHNIDCGPIQPGGACFDPNTVASHAAFAMNLYYQTSGRNPWNCDFSQTATLTTNNPSYNGCVYPGGST

SEQ ID NO: 405 - protein, 506 aa, Eucalyptus grandis
MAVPPFVLLLLLVGCASTVKSDQEPFIGVNIGTDLSDMPHPTQVVALLKAQNIRHIRLYNTDRGILAALANTGIQVIVSVPNEQLLGIGQSNSTAANWVSQNIIVHYPATNITGISVGSEVLTALPNAAPILVNALKFIHSALVASNLDRQIKVSTPLSSSVILDSFPPSQAFFNKSLNPVLVPMLNFLQSSGSYLMLNVYPYYDYMQSNGVIPLDYALFKPLPSNKEAVDANTLLHYSNVFDATVDAAYFAMAFLNFTNIPVVVTETGWPSKGDSNEPDATVDNANTYNSNLIRHVLNKTGTPKHPGITVSTYIYELYNEDTKAGPLSEKNWGLFDASGSPIYILHLTGSGSVLANDTTNQTYCTAKEGADPKMLQAALDWACGVGKVDCSPMLQGESCYEPDTLSAHATYAFDTYYHQMGKAPGTCDFNGVAAITTTDPSHGTCIFSGSLGRNATSVNVTAPSMNSTTSGSPALNYYNQHVLLLVVDESSGLECLVLVEWYISR

SEQ ID NO: 406 - protein, 489 aa, Eucalyptus grandis
MAESISHYPFPTLGLIVLCFMTMFSIGSSVGVNWGTQSNHQLPPEKVVKMLKENGIKKLKLFEYDEKILGALAGSKIEVMLAVPNYMLEIMSVDPSFAASWVDTNVTSYRYTGGVNIKYIAVGNEPFLQSYNHKYVRQVLPALRNIHEALHRARLSSKVKVTVPFNADVYYSPPPNEYPSSGDFRPEVRDAAIEIIHFLYINDSPFTVNIYPFLSLYQNQNFPVDFAFFDGTTEPVKDGDRVYTNVFDANFDILVSALTKAGYSDMEILVGEIGWPTDGDKFANIKNAQRFNQGLLKHALSGDGTPARKGVIDVYLFSLIDEDTKNIDPGNFERHWGLFEYDGKPKYELDLSGSEKDTRLVPVMGVSYMPRRWCILNPELNDLTDLGENIDYACKSSDCTALGYGSSCNNLSSQGNASYAFNRYYQMNDQRIMACDFQGLAEVTENDPSTEECQFPLMLASGDSMSWNQGSLHTSFRFYLWFLVFWVIL

SEQ ID NO: 407 - protein, 369 aa, Eucalyptus grandis
MAKIISMASGCSSAPAVCLLGLLIASFCTAGVQSIGVCYGMLGNNLPSASEVVALYKSRGITQMRLYDPSQPALQALRGSNIELILGVPNSELQALASNPANANSWVQRNVKNYSPGVRFRYIAVGNEVSPVNGGTAQFARFVLPAMRNIQAALRSSGLQNQIKVSTAIDMTLIGNSYPPSQGAFRGDVRSYLDPIISFLVNNNSPLLANIYTYFSYVGNPKDISLPYALFTSPSVVVRDGAHEYRNLFDAMLDALYSALERAGGASLRVVVSESGWPSAGAFAATVDNARTYNGNLIKHVKGGTPKRPNGAIETYIFALFDENQKQPELEKHFGLFFPNKQPKYPLSFAQGRIWDVYDNVTGPLKSDM

SEQ ID NO: 408 - protein, 491 aa, Eucalyptus grandis
MGFFKFIAFSRLCVALLFLAELVTSVGGIGVNWGTQTTHPLPPATVVRMLKDNGFQKVKFFDANSSYLSALSKSGLQVMLGIPNDMLSSLASNVEAAENWVAQNLSTYVSSNGVDIRHIAVGNEPFLSTYNGTYLNTTLPALQNVQAAVVKAGLSTQVKVTIPLNADVLESSTNLPSDGDFRSDIRDLMLEIVKFLSDNGAPFTINIYPFISLYNDPNFPAEFAFFDSSSSPLNDKGTIYTNVLDANHDMLVWALQKNGYGNMSITVGEIGWPTDGDKNANAKSAQRFNQGFMTQYSAGKGTPLRPGQMDAYLFSLIDEDAKSIQPGNFERHWGLFSFDGQPKYQLNLGSTSSNGLVAARDVKYLAKKWCVMSQSASLQDSQVAPSVSYACANADCTSLGYGNSCSNLTAQGNISYAFNSYYQQHDQLDTACQFPNLSVITDNDPSVGDCKFIIMIQSQSMSLVGSDGSRGRGIVPAILVSSLLYMILWMP

SEQ ID NO: 409 - protein, 499 aa, Eucalyptus grandis
MALLLLFLLLFPVSLASADEGPFIGVNIGTDLSNMPSPTQVVALLKAQNIRHVRLYDTDHAMLLALANSGIRVTVSVPNDQLLGIGQSNATAAYWVARNIVAHVPATNITVIAVGSEVLTTLQNAAPVLVSAMKFIHSALVASNLDSRIKVSTPHSSSIIIDSFPPSQAFFNRTWDPVMVPLLKFLQSTGSYLMLNVYPYYDYMQSNGAIPLDYALFRPLPPNKEAVDSNTLLHYNNVFDAVVDAAYFAMSYLNFTNVPIVVTESGWPSKGDSSEADATLENANTYNSNLIKHVLNNTGTPKHPGVAVSTYIYELYNEDQRPGSVSEKNWGLFDANGVPIYILHLTGAGTVLANDTTNQTFCVGKDGADKKMLQAALDWACGPGKVDCSLLLQGQACYEPDNVVAHATYAFNAYYQKMGKALGTCDFKGVATVTTTNPSHGSCIFPGSGGRNGTSVNGTILAPSSNSTTSGCPPQYFFDVGSITSSLIITILHLALVLL

SEQ ID NO: 410 - protein, 415 aa, Eucalyptus grandis
MGSAEERVVAVIMVGGPTKGTRFRPLSLNIPKPLFPLAGQPMVHHPISACKRIPNLAQIYLVGFYEEREFALYVSSISNELKVPVRYLKEDKPHGSAGGLYNFRDLIMEDSPSHIFLLNCDVCCSFPLPEMLEAHISYGAMGTLLVIKVSAESASQFGELIADPSTKELLHYTEKPETFVSDLINCGVYIFTPEIFSAIRNVSTQRKDRANLKRVSSFEALQPATRNLPTDFMRLDQDILSPLAGKRQLYTYETMDFWEQIKTPGMSLKCSGLYLAQFRSTSPHLLASGDGTKGATIIGDVYIHPSAKVHPTAKIGPNVSISANARVGAGARLMNCIILDDVEIKENAVVTHSIIGWKSSIGKWSRAQGGGDYNAKLGITILGEAVTVEDEVVVINSIVLPNKTMNISVQEEIIL

SEQ ID NO: 411 - protein, 381 aa, Eucalyptus grandis
MENSGEMEKVVAVIMVGGPTKGTRFRPLSFNTPKPLFPLAGQPMVHHPISACKRIPNLAQIFLIGFYDEKEFALYVSSISNELRVPVRYLKEDKPHGSAGGLYHFRNLIMEDSPSHIFLLNCDVCCNFPLPDMLEAHKRYGGMGTMLVVKVSAESANQFDVFSAIEDVSNDREDRANLRRLSSIDISTSTRTNIPTDFVRLDQDILSPLSGKKQLYTYETMDYWEQIKTPGISLKCSGLYLAQFRLTSPHLLASGDGTRSATVVGDVFVHPSAKVHPTAKIGPNVSISANVRVGPGVRLISCIILDDVELEDNAIVINSIVGWKSSLGRWSRVQADGDYNSKLGITILGESVVVEQEVVVVNSIVLPNKILNVSVQDEIIL

SEQ ID NO: 412 - protein, 361 aa, Eucalyptus grandis
MKALILVGGFGTRLRPLTLSVPKPLVDFANKPMILHQIEALKAIGVSEVVLAINYQPEIMLNFLKGFEAKLGIKITCSQETEPLGTAGPLALARDKLLDDSGEPFFVLNSDVISEYPLKEMIQFHKAHGGEASIMVTKVDEPSKYGVVIMEESTGQVEKFVEKPKIFVGNKINAGIYLLNPSVLDRIQLRPTSIEKEVFPKIAAEKQLFAMVLPGFWMDIGQPRDYITGLRLYLDSIRKKSSEKLATGPHIVGNVLVDETAKIGEGCLIGPDVAIGPGCVVESGVRLSRCTVMRGVRIKKHACISSSIIGWHSTVGQWARVENMTILGEDVHVGDEIYSNGGVVLPHKEIKSSILKPEIVM

SEQ ID NO: 413 - protein, 439 aa, Eucalyptus grandis
METRSSPKLRRLRCSVQKYDWGRRGAESRVAKLFALNSGAEADPDRPYAEFWMGTHGSGPSFLLPAGCGNGGHKVSPDVTLKAWISSNPDVLGDKVVAEWGCDLPFLFKVLSIAKPLSIQAHPDKELARALHKARPDVYKDANHKPEMALALTKFEAICGFISMEELKQVLCDVPEIAELVGSTDVEKFIKLGEQEVEKAKCLLQSIFTKLMSASADIVALAVSQINSRLELESQVRPLTDKEQLVLRLEKQYPADVGVISAFFLNYVRLNPGEALYLGANEPHAYVSGECIECMATSDNVVRAGLTPKTKDIQTLCSMLTYKQGFPDILKGVPLKTYITRYIPPFDEFEVDRCVLPKGSSAVFSAVLGPSIFLVTDGEGTINVGSVKQDVVAEGYVLFVPANVEIHVTSVTELHVYRAGVNDRFLKSRELENGKKSQI

SEQ ID NO: 414 - protein, 1024 aa, Eucalyptus grandis
MAGNDWINSYLEAILDVGPALDDKKSSLLLRERGRFSPTRYFVEEVITGFDETDLYRSWVKAQATRSPQERNTRLENMCWRIWNLARQKKQLEGEEAQRKSKRRLERERGRREATADMSEDLSEGEKGDAVSDISTHGDSNRGRLPRISSVDAMETWVGQQKGKKLYLVLISLHGLIRGENMELGRDSDTGGQVKYVVELARALGSMPGVYRVDLLTRQISSPDVDWSYGEPTEMLSPRNSEGLSDEMGESSGAYIVRIPFGPRDKYVPKELLWPHIREFVDGALSHVIQMSKVLGEQVGGGQPVWPVAIHGHYADAGDSAALLSGALNVPMLFTGHSLGRDKLEQLLKQGRLSRDEINTTYKIMRRIEAEELSLDSSEIVITSTRQEIDEQWRLYDAFDPILEKKLRARIKRNVSCYGRFMPRMAIIPPGMEFHNIAPQDGDMDGEMEGNDDHPTTQDPPIWTEIMRFFNNPRKPMILALARPDPKKNITTLVKAFGECRPLQELANLTLIMGNRDGIDEMSSTSSSVLLSVLKLIDKYDLYGQVAYPKHHKQSDVPDIYRLAAKTKGVFINPAFIEPFGLTLIEAAAHGLPMVATKNGGPVDIHRVLDNGLLIDPHDQRSIADALLKLVADKHLWARCRQNGLKNIHLFSWPEHCKTYLSRIASCKPRHPQWQRSEDGLGNSESDSPSDSLRDIQDLSLNLKFSLDGEKNDASGNENSVGSEENSADRKNKLENAVMTWSKGVLKDKKTGLVEKSDPNANSSKFPPLRRRKHIFVLAVDCDSLTDLLEIIQKVFSSVENERNEGSIGFILSTSLTMSEVHSFLVSGGLSPNDFDAFICNSGSDLYYPSLNSENRPFVIDFYYHSHIEYRWGGEGLRKTLVRWATNINDKRAENEAQIVTLAEKLSTDYCYTFKVEKLGMVPPVKEVRKMMRIQALRSHAVYCQNWTRLNVIPVLASRAQALRYLYVRWGVDLSKMVVFVGECGDTDYEGLLGGLHKSVILKGVCGSASNQFHANRNYPLSDV

SEQ ID NO: 415 - protein, 1024 aa, Eucalyptus grandis
MAGNEWINGYLEAILDAGRYNVKRRGDGKIGGGGKGGVVATEFDGNEREGSLFSPTRYFVEEVVNSFDESDLHKTWIKVIATRNTRERNNRLENMCWRIWHLARKKKQIAWDDAQRLAKRRLEREQGRSEAADDLSELSEGEKEKGDGSHSPEPAKDKIARINSDLQAWSDDEKPRQLYIVLISMHGLVRGENMELGRDSDTGGQVKYVVELARALASTKGVYRVDLLTRQITSHEVDSSYGEPIEMLSCPADAGDGCGAYIIRMPCGPSNEYIPKESLWPHVPEFVDGALNHIVNMARVLGEQIDGKPVWPYVIHGHYADAAEAAALLSGVLNVPMVLTGHSLGRNKFEQLLKQGRLSREDINTTYKIMRRIEAEELGLDAAEMVVTSTRQEIEEQWGLYDGFDLKLERKLRVRRRRGVSCYGRYMPRMVVIPPGMDFSNVKVEDSTESESDLKSLISSDKTPNKRHLPRIWSEVMRFFSNPHKPMILALSRPDPKKNVTTLLKAFGECQHLRELANLTLILGNRDDIEEMPEGSSVVLTNVLKLIDKYNLYGQVAYPKHHKQSDVPEIYRLAAKTKGVFINPALVEPFGLTLIEAAAYGLPIVATRNGGPVDILKALNNGLLIDPHDQKAIADALLKLVADKSLWAECRKNGLKNIHCFSWTEHCHNYLSQVDHCRNRHPTSRFQIMPIPEEPLSESLRDVEDLSLKFSIDGELKANGELDLATRQKELIEALTRKVHPNGGSPSISLSSRRQKIFAIALDPYDSGGLFTNIFRVTIKNIMKVARGYSGLNRVGFVLLTGATLQETLNAFKGSDINVEEFEALSCNSGSSIYYPGRDFIADVDYEGHLEYRWPGDNVRSMVLRLAKAEDGMEDDIEELKAGCNSRCFAFSIKPGGKVRRIDDLRQALRMRGFRCHIVYSCAGTRLSVMPLFASRIQALRYLSIRWGIDFADSVVFVGDKGDTDYEQLLGGLHKTIILNGTVECGSEKLLRSEENFKRVDVVALNSPRIRIVEDGSEEDISRA

SEQ ID NO: 416 - protein, 1024 aa, Eucalyptus grandis
MAGNEWVNSYLEAILDVGPALDDPKSSSLLLRERGRFSPTRYFVEQVITGFDETDLHRSWLRAAATRSPQERNTRLENMCWRIWNLARKKKQLEGEEAQRIAKRRLEHERGRREATADMSEDLSSEGEKGDSATDISSQGGERMPRTGSVDIMDKWASRQKDCKLYLVLISLHGLVRGENLELGRDSDTGGQVKYVVELARALGTIPGVYRVDLLTRQISAPDVDWSYGEPTEMLRTRNSEFPLQEIGESSGSYIIRIPCGPRNKYVQKELLWPHIPEFVDGALSHITQMSKVLGEQIGGGRPVWPAAIHGHYADAGDAAALLSGALNVPMLFTGHSLGRDKLEQLLKQGRLAEEINTAYKIRRRIEAEELSLDTSEIIITSTRQEIEQQWRLYDGFDPVLERKLRARIKRGVSCHGRYMPRFVVIPPGMEFRNIVPHDGDMNGEVEKNPPIWPEIMRFFSNPRKPMILALARPDPKKNITTLVKAYGECHQLRELANLTLIMGNRDDLDEMSTTNAAVLLSILKLIDKYNLYGQVSYPKHHKQSDVPDIYRLAAKTKGVFINPALIEPFGLTLIEAAAYGLPVVATKNGGPVDILRVLDNGQLVDPHDQHAIANALLKLVSDKQLWSRCRENGLKNIHLFSWPEHCRTYLSRIISCKPRGPQWQNNDDKLDKSESDSPGDSLRDIQDISLNLKFTLDGEKSEGNATFLEENADDAKSNVENTVLTLAKGVLRGIAKGTSTEKANEDIGAGDFSTFRRRKWIYVIAVDCDATADYIDIIKRIMEATRKENAAGFILSTALTILEVHSLLTSGGLNLTDFDAFICSSGSDLLYPSSSSDDGPSGLPFVIDLDYRSHIEYRWGGEGLRKTLVRWAASINDKKDGENIVAEDESGSSSYCFSFKVEDYDLIPPVKELRKLMRIQALRCHVVCCQNGRKLNVIPVLASRVQALRYLFVRWGMDLSKFVVFVGECGDTDYEGLIGGVHKTVILKGLGCESRKLHAHRGYPLEHVVPYDSPNVAEAEGSD

SEQ ID NO: 417 - protein, 293 aa, Eucalyptus grandis
MASPAWALFLGLVLMASGAMGAAPRKPVAVPFGRNYMPTWAFDHIKYFNGGSEIQLSLDKYTGTGFQSKGSYLFGHFSMDIKLVAGDSAGTVTAFYLSSQNSEHDEIDFEFLGNRSGQPYIVQTNVFTGGKGDREQRIYLWFDPTAAYHSYSVLWNMYQIVFFVDDVPIRVFKNSKDLGVKFPFNQPMKLYSSLWNADDWATRGGLEKTDWSKAPFVASYRGFHIDGCEASVEAKFCATQGQRWWDQKEFQDLDAFQYRRLRWVRSKYTIYNYCADRKRYPAMSPECRRDRDV

SEQ ID NO: 418 - protein, 289 aa, Eucalyptus grandis
MAFQGVLSNKMAMALVALGLLVAAAAASGNFNKDFDITWGDGRAQIPSSGQLLTLSLDKTSGSGFRSKKQYLFGKIDMQLKLVPGNSAGTVTAYYLSSLGSAHDEIDFEFLGNLSGDPYTLHTNVFTQGKGNREQQFHLWFDPTKDFHTYSILWNPQSIIFSVDGTPIREFKNLESKGVAFPKSQAMWIYSSLWNADDWATRGGLVKTDWTQAPFTASYRGFNDEQACVGSSGSSSCSSSSGDKSWLSQSLDATGQQRIKWVQKNYMIYNYCADTKRFSQGFPPECSLS

SEQ ID NO: 419 - protein, 291 aa, Eucalyptus grandis
MASPSAPSLCITTLLLVVVSWATSASARNFYQDFDITWGDGRAQILNNGDLLTLSLDKASGSGFQSKNEYLFGKIDMQLKLVPGNSAGTVTAYYLSSNGSTWDEIDFEFLGNLSGDPYILHTNVFSQGKGNREQQFYLWFDPTADFHTYSILWNPQRIIFSVDGTPIREFKNAESIGVPFPKAQPMRIFSSLWNADDWATRGGLVKTDWTQAPFTASYRNFNADNTCIWSSGSSSCTSSSSSSDGNAWLSEELDSTSQERLKWVQSNYMIYNYCTDAKRFPQGLPRECAMS

SEQ ID NO: 420 - protein, 291 aa, Eucalyptus grandis
MASRSTSSLCRAALLLMVVSWATSASARNFYQDFDITWGDGRGQILNNGDLLTLSLDKASGSGFQSKNEYLFGKIDMQLKLVPGNSAGTVTAYYLSSNGSTWDEIDFEFLGNLSGDPYILHTNVFSQGKGNREQQFYLWFDPTADFHTYSILWNPQRIIFSVDGTPIREFKNAESIGVPFPKAQPMRIFSSLWNADDWATRGGLVKTDWTQAPFTASYSNFNADNACVWSSGSSSCTSSSSSSDGNAWLSEELDSTSQESLKWVQSNYMIYNYCTDAKRFPQGFPPECSMS

SEQ ID NO: 421 - protein, 291 aa, Eucalyptus grandis
MASRSTSSLCTTALLLLVVSWAASAFARNFYQDFDITWGDGRAQILNSGDLLTLSLDKASGSGFQSKNEYLFGKIDMQLKLVPGNSAGTVTAYYLSSNGSTWDEIDFEFLGNLSGDPYILHTNVFSQGKGNREQQFYLWFDPTADFHTYSILWNPQRIIFSVDGTPIREFKNAESIGVPFPKAQPMRIFSSLWNADDWATRGGLVKTDWTQAPFTASYRNFNADNACVSSSGSSSCTSSSSSSDGNAWLSEELDSTSQERLKWVQSNYMIYNYCTDAKRFPQGVPPECTMS

SEQ ID NO: 422 - protein, 247 aa, Eucalyptus grandis
MASLSTSSLCIATLLLVVVSWGTFASARNFYQDFDITWGDGRAQILNNGDLLTLSLDKASGSGFQSKNEYLFGKIDMQLKLVPGNSAGTVTAYYLSSNGSAWDEIDFEFLGNLSGDPYILHTNVFSQGKGNREQQFYLWFDPTADFHTYSILWNPQRIIFSVDGTPIREFKNAESVGVPFPKAQPMRIFSSLWNADDWATRGGLVKTDWTQAPFTASYRNFNADNACVWSSGSASCTSSSSSSDGNA

SEQ ID NO: 423 - protein, 296 aa, Eucalyptus grandis
MAHEGGGPSASSMVVFVSLLLMAAASPAAGNFYQDFDLTWGGSDRAKIFSGGQLLSLSLDRVSGSGFRSKKEYLFGRIDMQLKLVAGNSAGTVTAYYLSSQGPTHDEIDFEFLGNLSGDPYILHTNVFTQGKGNREQQFYLWFDPTRNFHTYSVIWKPQHIIFLVDNIPIRVFKNGESIGVPFPKNQPMKIYSSLWNADDWATRGGLIKTDWSKAPFTAYYRKFQATACTWSTGSSSCEIGRPASYSGSTWKINELDAYGRRRLRWVQKYFMIYDYCADGKRFPQGIPAECKRSRF

SEQ ID NO: 424 - protein, 296 aa, Eucalyptus grandis
MAHEGGGPSASSMVVLVSLLLMAAASPAAGNFYQDFDLTWGGSDRAKIFSGGQLLSLSLDRVSGSGFRSKKEYLFGRIDMQLKLVAGNSAGTVTAYYLSSQGPTHDEIDFEFLGNLSGDPYILHTNVFTQGKGNREQQFYLWFDPTRNFHTYSVIWKPQHIIFLVDNIPIRVFKNGESIGVPFPKNQPMKIYSSLWNADDWATRGGLIKTDWSKAPFTAYYRKFQATACTWSTGSSSCEIGRPASYSGSTWKINELDAYGRRRLRWVQKYFMIYDYCADGKRFPQGIPAECKRSRF

SEQ ID NO: 425 - protein, 298 aa, Eucalyptus grandis
MAVPVFSKVSVSFGLFVGLALLVGLVAGARFEELYQPGWAMDHFVYEGEVLKLKLDNYSGAGFGSKSKYMFGKVTIQIKLVEGDSAGTVTAFYMSSDGPNHNEFDFEFLGNTTGEPYLVQTNVYVNGVGNREQRLGLWFDPTTDFHSYSVLWNQRQVVFLVDETPIRVHTNLEHRGIPYPKDQPMGVYSSIWNADDWATQGGRIKTDWTHAPFITSYRNFEIDACECPATMAAADNAKRCSSAGRERRYWWDEPTVSELSLHQNHQLKWVQAHHMVYDYCKDTARFPVMPAECEHHRH

SEQ ID NO: 426 - protein, 287 aa, Eucalyptus grandis
MASAALAMILFTSVLLKSLMVASAGNLNQEFDITWGDGRAQILNNGDLLTLSLDKASGSGFQSKNEYLFGKIDMQLKLVPGNSAGTVTAYYLSSKGSTWDEIDFEFLGNLSGDPYILHTNVFSQGKGNREQQFYLWFDPTADFHTYSILWNPQRIIFSVDGTPIREFKNAESSGVPFPKSQPMRIYSSLWNADDWATRGGLVKTDWSRAPFTASYRNFNADACVWSSGSSSCGSGAASSDGSSWLTQELDTTSQQRLKWVQQNYMIYNYCSDSKRFPQGPPPECNLS

SEQ ID NO: 427 - protein, 305 aa, Eucalyptus grandis
MQDSRMEKMVSPLSILLCISLVLLAEPRSSDAAPQSKGSFVDNFDIMWSEEHFKTSADGQIWYLSLDKETGCGFQTKQRYRFGWFSMKLKLVGGDSAGVVTAYYMCSENGAGPERDELDFEFLGNRSGQPYLIQTNVYKNGTGSREMRHMLWFDPTEDFHSYSILWNSHQIVFFVDQVPVRVFKNNGEANNFFPNEKPMYLFSSIWNADDWATRGGLEKTDWTKAPFVSTYKDFSFDGCQWEDPFPACVSTTTKNWWDQYSAWHLSEDQKKDYAWVQRNLVIYDYCKDTQRFPTLPWECSLSPWD

SEQ ID NO: 428 - protein, 332 aa, Eucalyptus grandis
MLHSHLGLLSLTCFAVLLVLASGSSPNLPIISFDEGYTQLFGDNNLALHGDGQSVHLALDERTGSGFASQDLYLHGFFSASIKLPADYTAGVVVAFYMSNGDMYEKNHDEIDFEFLGNIREKNWRIQTNIYGNGSTSVGREERYGLWFDPSDDFHQYGILWTDSQIIFYVDNVPIREFKRTEAMGGQFPSKPMSLYATIWDGSDWATNGGKYRVNYKYAPYVAKFSDLVLHGCAVDPIEHQLSCNDVPSHKAIPQGISPRQRTKMEYFRKKHMTYSYCYDRARYKVPPPECVINPGEAEHLRVFDPVTFGDGRHHRPKRHRQSRTSRADASI

SEQ ID NO: 429 - protein, 335 aa, Eucalyptus grandis
MSASWSVTSCLFFASCALLVVLAVGSPENSNSELPVVSFDEGYAHLFGDDNLVIHGDGKSVHLTLDERTGSGFVSQDLYLHGFFSASIKLPADYTAGVVVAFYMSNGDMFEKTHDEIDFEFLGNIRGKEWRVQTNVYGNGSVGVGREERYNLWFDPSDDFHQYSILWTDSLIVFYVDNVPIREVKRTKAMGGDFPSKPMTLYATIWDGSSWATNGGKYRVSYKYAPYIVEFSDLVLHGCAVDPMEHSSACDAVLPSGSIPTAITREQRVQMESFRKRHMTYSYCYDRARYKIPPPECILSVKEAKHLRSFDPVTFGQGKRHFAKRRHRRVSATSM

SEQ ID NO: 430 - protein, 297 aa, Eucalyptus grandis
MALLYLSLLLVLLMLPICPGNAQWPPAPGYWPSSRFRSMSFYQGFKNLWGPQHQRVDQSALTIWLDSTSGSGFKSVKPFRSGYFGASIKLQPGYTAGVITSFYLSNGEAHPGFHDEVDIEFLGTTFGKPYTLQTNVYIRGSGDGRIIGREMKFHLWFDPTQAFHHYAILWRPNELIFLVDDIPIRRYPRKSAATFPMRPMWLYGSIWDASSWATEDGKYKADYRYQPFIARYTNFKASGCSAYSPAWCRPVSASPYRSGGLTRQQYRVMRWVQAHHMVYNYCRDSRRDHSLTPECRI

SEQ ID NO: 431 - protein, 292 aa, Eucalyptus grandis
MKYLRSFLVIVSVLNLVCVSFSSVVSTGNFNKDFFVMWSPDHVNTSADGRTRSMVLDQESGAGFSSNDMFLFGQIDMKIKLISGHSAGTVVAFYLTSDQPNRDEIDFEFLGNVSGQPYILQTNVYADGFDNREERIYLWFDPTQDFHNYSILWNLHQIVFFVDSIPIRTYRNHADKGVAFPRWQPMGVKATLWNGDSWATRGGHDKIDWSKGPFVASFGDYKMDACVWKGNPRFCRAESPTNWWNNEDFSSLTSTQRRWFKWVRRYHMIYDYCQDNARFQNNLPKECSLPKY

SEQ ID NO: 432 - protein, 291 aa, Eucalyptus grandis
MTSPSTRLCVCLFHLAAISALASAGNFYKDFDITWGDHRSQILNGGQELTLSLDQASGSGFKSKNEYLFGRIDMEIKLVEGNSAGTVNAYYLSSQGPTHDEIDFEFLGNLSGNPYTLHTNVFSQGKGNREQQFHLWFDPTKAFHTYSIVWNTRRIIFLVDNSPIRVFNNLESIGVPFPSNQPMRIYSSLWNADDWATMGGRVKTDWTKAPFTASFRNFNANACVVSSGSSSCGSKSTNNLQTSAWQEQSLNAAGRNRLRWVQQKYMIYNYCSDSKRFPQGLPPECKRSRFL

SEQ ID NO: 433 - protein, 297 aa, Eucalyptus grandis
MPTSISSYSFPRTTMLVVCAILIGSSVVALAGNFYQDFDVTFGDGRVKVLDNGQLVTLSLDKASGSGFKSKNQYLYGKFDMQIKLVPGNSAGTVTTLYLHSDGSTWDEIDLEFLGNLSGDPYILHTNLYSQGKGNREQQFYLWFDPTADFHTYSVLWNPVHVVYYVDGIPIREFKNLNAAGVPYPKSQPMTLYSTLWDAEDWATRGGLVKTDWSQAPFTASFSGFNASACVWSNGASTCLSSSAASAKYPWFSQQLDAASLQTMKSVQQKYMIYDYCKDTKRFPQGLPLECTLKTKS

SEQ ID NO: 434 - protein, 314 aa, Eucalyptus grandis
MALLQENTLFFSLLFLLCMAISVSSHNRPYSPPDVPRLTDLFPHVAVDQGFSKFFGAQNVRLLNNGSYANLALDKSSGSGLVSRSKYHYGFFSAAVKLPAGLSSGVVVAFYLSNADAFPHSHDEIDIELLGHDKRNDWVLQTNIYSNGSVSTGREEKFYFWFDPTQEHHYYSIIWNSHHIVFFVDNIPVREFPSSGVFSSTYPSKPMSVYATIWDGSQWATHGGKYPVNYKYAPFVVSLAETEMVGCVSNPRQQPLSSCSNQSTSSGSDPVEGQDFAALSQQQITAMQWARSKLMFYSYCKDTSRFKVMPPECK

SEQ ID NO: 435 - protein, 353 aa, Eucalyptus grandis
MDPLRRLVSLAVTTSSSSSSSSSLTLLLALLFYAASAAAAFDIVPITFDEAYAPLFGDSNVVRSGDGKSVRLLLDRFSGSGFISSNLYKYGFFSARIKLPSDYTAGIVVAFYTSNGDVFEKTHDELDIEFLGNIKGKKWRFQTNVYGNGSTSRGREERYTLWFDPTRAFHRYSILWTANNIIFYVDEVPIREIIRNDAMGGDFPAKPMALYATIWDASDWATSGGRYKVNYKYAPFVAEFKDLVLQGCPVDPIDQYSSGHCYDKLALLEAQDFATVTAQRHAAMRRFRQNYMYYSYCYDTVRYAIPPPECVILQSEKERFKDTGRLKFGGSHKKRSRRRGHRIPLVSEEQPVM

SEQ ID NO: 436 - protein, 355 aa, Eucalyptus grandis
MDRHPPPHSRRFSLYQPPSYFSLSLLSIFIFSCFLSTSDAAFDVTPISFDEGYRPLFGDGNVVRSPAGDGVRILLDRFTGSGFISSDMYQHGFFSAKIKLPSDYTAGVVVAFYTSNGDVFEKTHDELDIEFLGNIRGKPWRFQTNVYGNGSTSRGREERYTLWFDPTKEYHRYSILWTANKIIFYVDEVPIREIVKSEAMGGDFPSKPMSLYATIWDASDWATSGGRYKVNYKYAPFVAEFKDLVLEGCMADPIRQLPASGCHAKDAQLEARDFATITSSQRRAMRRFRERYMYYSYCYDTLRYPVPPPECMIIPSEKARFKDTGRLKFGGSHKRRSRRRERIPAASVSDNQASM

SEQ ID NO: 437 - protein, 304 aa, Eucalyptus grandis
MSHPRTQMAISKRRSPSCSLIALTMMVWLWSSHVVPRVAGCDGFDELFQPNWAPEHFECEGDQTKLTLDSSSGCGFGSRKAYLFGLTSVQIKLVQGDSAGTVTAFYMSSDGPNHDELDFEFLGNLSGEPYLVQTNVYVNGTGDREQRHSLWFDPTTDFHTYSLFWNRRYITFLVDGIPIRVFANKEESHGVPYPKNQPMRVLGSVWNADDWATQGGRVKTNWSHAPFVSSFRAFDIDACELSPETADVTTKCGQLGRYWWDRPSFNELGRRQSRQLKWVCKKYLVYDYCEDKPRFSELPKECVG

SEQ ID NO: 438 - protein, 195 aa, Eucalyptus grandis
MAKPGLTAMVVAALALVVAMVATLAHAEADDPKKVDAWFNGLSHADRKTTRLHFYFHDTLSGRNPTAVRVAEATMTEKSPTLFGVVNMIDDPLTEGPEPESPLVGRAQGFYGSVGLESMALHMNMNLVFTTPEYNGSTLSILGHNPALETYREMPIVGGTGVFRLASGVVTAKTYFLNLTTGDAVVEYKVIALHY

SEQ ID NO: 439 - protein, 198 aa, Eucalyptus grandis
MAKPGLTAMVVAAVALVVAAVALVVAMVAKHAHAEADDPEKVDAWFNGLSHADRKTTRLHFYFHDTLSGSNPTAVRIAEAKSPTGFGVVNMIDDPLTKGPEPESPLVGRAQGFYGSVGLESTALHMSMNLVFTTPEYHGSTLSILGRNPALETYREMPIVGGTGVFRLASGVVTAKTYFLNLTTGDAVVEYKVIALHY

SEQ ID NO: 440 - protein, 186 aa, Eucalyptus grandis
MGARVIVSLLFLFLIFGSNADAANKRIRNRRPCKRLVFFFHDVLYNGNNAKNATSAIIGAPAWANQTILAGQSHFGDLVVFDDPITLDNNLHSKPVGRAQGFYIYDKKDIFTAWLGFSFVFNSTQHTGSLNFAGADPLMNKTRDISVIGGTGDFFMARGVATLMTDSFEGEVYFRLRTDIKLYECW

SEQ ID NO: 441 - protein, 192 aa, Eucalyptus grandis
MATLSPISSLLLLLLLLLSSGSPTLASAFATALDPSLMGINLGKEKLSHFRFYWHDVQSGPHPSSVTVVPPPSNSSATFFGLINMIDNPLTLRPDPGSELVGRAQGLYSSASQEEVGLLMIMNFAFVAGKYNGSGITVLGRNPVLQKVREMPVISGCGLFRFARGYAQATTHTFDRKTGDAVVEYNVYVLHY

SEQ ID NO: 442 - protein, 190 aa, Eucalyptus grandis
MATLIPISSLLLLVLLSSAAPAPASAFATALDPSLMGVHLGKEKLSHFRFYWHDVLSGPNPSSVRVTTPPSNASATGFGLVNVIDNPLTLLPDPASELVGRAQGLYSSASQEEVALLMIMNFAFVSGKYNGSGITVMGRNPVFHKVREMPVISGCGVLRFARGYAQASTHTFDLKTGNAVVEYNVYVLHY

SEQ ID NO: 443 - protein, 195 aa, Eucalyptus grandis
MVKPGLTAMVVAALALALATAVALACAEVDDPEKVNAWFNRLSHAEHKTTHLHFYFHDTLSGKNPTAVRIAEATMTEKSPTLFGVVNMIDDPLTEGPEPESPLIGRAQGFYGSVGLESLALHMNVNLVFTTPEYNGSTLSILGRNPALETYREMPIVGGTGVFRLASGVATAKTYFFNLTTGDAVVEYKVIAMHY

SEQ ID NO: 444 - protein, 186 aa, Eucalyptus grandis
MALISAPKMLTATTFSQLLLLSTYSILMHSYSSKATVQHPHTTKLVLYFQDIIAGPNANDIPVVGIPGKLWSFSQFGTVFVADEPITETPDPNSAMVGRAQGMYVISSLDGSNVKTVFSIVFTNQAYNGSTLELQGAGKQLQRVLEFAVVGGTGKFRFARGYTTLETISFSQGHGVIQFNVTVRHD

SEQ ID NO: 445 - protein, 185 aa, Eucalyptus grandis
MRNLVAHKSCFLVLFLLLLFTSQFSSATKKTFNRDQPCKRFVLYFHDILFGGNDVANATSAAVANETGLGNFKFGKLFVFDDPMTKDKNYLSPAVARAQGFYFYDMKNDYNAWFAYSLVFNSTEHKGTLNIMGADIMAAQTRDLSIVGGTGDFFMARGIATFETDLFQGAKYFRIKMDIKLYECY

SEQ ID NO: 446 - protein, 190 aa, Eucalyptus grandis
MAVHIAKLVAFSLLCMSTVFVAANSHTFARSLLPQELGLKKEKLSHLHFYFHDIVSGRNPTAVRVAEAKMTNSSATGFGAVVMIDDPLTEGPEMSSKEVGRAQGIYALSSQNDVGLLMVQNYVFTEGKYNGSTLSVLGRNAVFSGVREMSIVGGSGLFRFARGYAQAKTHTMDRKTGDTVVNYNVYVFHY

SEQ ID NO: 447 - protein, 259 aa, Eucalyptus grandis
MASVSRVVGLVSLILFSTLAEARIPGVYTGGPWQSAHATFYGGSDASGTMGGACGYGNLYSQGYGVNTAALSTALFNNGFSCGACFEIKCANEPQWCHSGSPSILVTATNFCPPNYALPNDNGGWCNPPRPHFDLAMPMFLKIAEYRAGIVPVSYRRVPCRKQGGIRFTINGFRYFNLVLVTNVAGAGDINKLWVKGSKTGWMSMSRNWGQNWQSNSVLAGQSLSFRVTAGDRRTSTSWNIVPSNWQFGQTFTGKNFRV

SEQ ID NO: 448 - protein, 263 aa, Eucalyptus grandis
MAAARVMALALAFLGVALSATRMAEARIPGIYTGGPWQSAHATFYGGADASGTMGGACGYGNLYSQGYGVNTAALSTALFNNGFSCGACFEIKCANDPQWCHSGSSSIFVTATNFCPPNYAQPSDNGGWCNPPRPHFDLAMPMFLKIAEYRAGIVPVAYRRVPCRKRGGIRFTINGFRYFNLVLISNVAGAGDIVRVSVKGSRTGWMSMSHNWGQNWQSNSVLVGQSLSFRVTGSDRRTSTSWNIVPAGWQFGQTFTGKNFRV

SEQ ID NO: 449 - protein, 260 aa, Eucalyptus grandis
MTRASVVFAASLISFSLMWLADARIPGVYSGGPWQTAHATFYGGSDASGTMGGACGYGNLYSQGYGVNTAALSTALFNNGLSCGACFEIKCANDPTWCHSGSPSIFVTATNFCPPNFAQPSDNGGWCNPPRPHFDLAMPMFLKIAEYRAGIVPVSFRRVPCRKRGGMRFTINGFRYFNLVLISNVAGAGDIVRVSVKGARTGWMSMSRNWGQNWQSNAVLAGQALSFRVTASDRRSSTSWNMVPAGWQFGQTFTGKNFRV

SEQ ID NO: 450 - protein, 276 aa, Eucalyptus grandis
MQQRRRGSPSSSSSAAALLLGRLWLLLVLGAATTSASAQVKKRVPNARWKPATATWYGSPDGDGSDGGACGYGSMVDVRPLRARVGAVSPVLFKNGEGCGACYKVKCLDRGICSRRAVTIIVTDECPGGYCSGGNTHFDLSGAAFGRMAIAGEAGPLRNRGVLPVQYRRTPCKYPGKNIAFHVNEGSTDYWLSLLVEFEDGDGDVGSMHIRPASSSEWIEMKHLWGANWCITGGPLQGPFSVKLTSLSTNRTLSARDVIPGNWSPKATYTSRLNFF

SEQ ID NO: 451 - protein, 249 aa, Eucalyptus grandis
MANFAAISAVALVFLCLKSAFGDYGGWEGGHATFYGGGDASGTMGGACGYGNLYSQGYGTNTAALSTALFNNGLSCGACYEMRCNDDPRWCLPGTIMVTATNFCPPNLALSNDNGGWCNPPLQHFDMAEPAFLQIAQYKAGIVPVSFRRVPCVKKGGVRFTINGHSYFNLVLITNVGGAGDVHSVSIKGSRTGWQAMSRNWGQNWQSNAYMNGQALSFQVTTSDGRTVTSYNAAPANWQFGQTFEGSQF

SEQ ID NO: 452 - protein, 250 aa, Eucalyptus grandis
MAVVGLLLVGCLAMWVCSVDGYGGGGWINAHATFYGGSDASGTMGGACGYGNLYSQGYGTNTAALSTALFNNGLSCGSCYEIRCVNDRQWCLPASIVVTATNFCPPNNALPSNAGGWCNPPLQHFDLSEPVFEHIARYRAGIVPVAYRRVPCRRRGGIRFTINGHSYFNLVLITNVGGAGDVHAVSVKGSRTGWMSMSRNWGQNWQSNNYLNGQSLSFKVTTSDGRSVMSYNAAPAHWSFGQTFSGVQFR

SEQ ID NO: 453 - protein, 293 aa, Eucalyptus grandis
MAVVGLLLVGCLAMWVCSVDGYGGGGWINAHATFYGGSDASGTMGGACGYGNLYSQGYGTNTAALSTALFNNGLSCGSCYEIRCVNDRQWCLPASIVVTATNFCPPNNALPSNAGGWCNPPLQHFDLSEPVFEHIARYRAGIVPVAYRRYVHCNARPSFFGRVKKLGACVKHMNSLVRLVNLQCPVWGTFCRVPCRRRGGIRFTINGHSYFNLVLITNVGGAGDVHAVSVKGSRTGWMSMSRNWGQNWQSNNYLNGQSLSFKVTTSDGRSVMSYNAAPAHWSFGQTFSGAQFR

SEQ ID NO: 454 - protein, 259 aa, Eucalyptus grandis
MALLLCFLLSLFISSATACDRCVHQSKAAYFSKASALSSGACGYGSLAVGLNSGFLAAAIPSLYKDGAGCGACFQIRCKNANLCTKGGTRVIVTDLNRNNNTDFVLSSRAFAAMARQGMSQDILRQGIVDVEYKRVPCDYKDRNLAVRVEESSRKPNYLAIKVLYQGGQTEIVAMDVAQVGSSYWTYMSRNHGAVWNTSRVPDGALQFRFVVTPGYDGKWIWAKSVLPADWQNGVVYDSGVQITDIAQEGCSQCDDGSW

SEQ ID NO: 455 - protein, 273 aa, Eucalyptus grandis
MALLQSPSICFPLALLLALLINSSHCFNPKSLNISKVQSNGDWSPAGATWYGSPNGAGSDGGACGYGSGVDQAPFSSMVSAGGPSLFKSGKGCGACYQVKCTENAACSGNPVTVVITDECPGGPCVAESAHFDLSGTAFGAMASSGKADELRNAGVLQIQYQKVKCNFPGAKVAFHVDSGSNPNYFAALIEYEDGDGELGAVNLKQALDSDSWLPMQQSWGAVWKLDGAGQLRAPFSIKLTSLDSGKTLVANNVIPAGWQPGQTYRSVVNFAV

SEQ ID NO: 456 - protein, 129 aa, Eucalyptus grandis
MEVKLQVLVALAMALSLFSAASATAGLAVYYAPQYYPAACPGFTLKNSGVMVAGVSDALWNNGRACGRMLKVRCTRAANQFPNPCRAGVITVKVVDYCRQPCNGVINLSQDAFAKIANLDAGKVWVDYS

SEQ ID NO: 457 - protein, 134 aa, Eucalyptus grandis
MLPKTISVATGDDGTASYYVPPYERTECYGEGSSQFPESNFFAAVGDNLWDLGAACGREYEVRCISKAQSGPGPCKPGSDTIRVKVVDYALSVSSSAAAPKQSVTGADLVLSQIAFEAIANPSVDSITVELKEV

SEQ ID NO: 458 - protein, 244 aa, Eucalyptus grandis
MVPLGFLVVGLLSQFVPVSRAYGYYGGWTNAHATFYGGSDASGTMGGACGYGNLYSQGYGTNTAALSTALFNNGLSCGACFELRCVNDPQWCLPGAIVVTATNFCPPGGWCDPPQLHFDLSQPVFQHIAQYRAGIVPVAYRRVRCRRSGGIRFTVNGHSYFNLVLITNVGGAGDVHSVAIKGSRTRWQPMSRNWGQNWQSNSDLNGQSLSFLVTASDGRSVVSYNVAPSGWSFGQTYTGGQFRY

SEQ ID NO: 459 - protein, 370 aa, Eucalyptus grandis
MASKSSTSPAFLFSMILALVVGINGGGIAIYWGQNGNEGTLAEACASGNYKFVNLAFLNVFGNGQTPMINVAGHCDPSSGGCTGLSSEIKSCQARGVKVMLSIGGGVGSYYLPSAEDARYVATYLWDNFLGGQSSSRPLGDAVLDGIDFVIATGTNQHWDDLARYLSAYSISGKKVYLAAAPQCPYPDAWVGGALQTGLYDYVWVQFYGNPPCEYSSGNMGNLEDAWNQWTSIPAGEIFLGLPASADASSGFIPASNLTSIVLPTIKGSAKYGGVMLWSRTVFPSSRASGHDSHVYARDGFPDSPIRRFPIRRFSVSIQLGYVMIVDGSSSQLLLKRRRLAIPDPMEAEPAKVLSLSLSHSIFSMLMLGL

SEQ ID NO: 460 - protein, 301 aa, Eucalyptus grandis
MPSPPPSKPSLSLLLLLFSSSLIRASHGGGIAIYWGQNGNEGTLASTCATGKYAYVNLAFLYKFGGGQTPQINLAGHCDPTSGGCTSTSNGIRSCQNQGIKVMLSLGGGVGSYSLASQADARNVANYLWNNFLGGTSSSRPLGDAVLDGIDFDIELGSTKYWDDLARYLSDYSKQGKKVYLTAAPQCPYPDSHMGAALNTGLFDYVWVQFYNNPPCQYSSGDISKLTSSWSKWVASINAGKMFVGLPASTEAAGSGYVPPNVLTSQILPVIKKSAKYGGIMLWSKYYDDKNGYSDSVKSSV

SEQ ID NO: 461 - DNA, 60 bp, Artificial Sequence
  Description of Artificial Sequence: Synthetic oligonucleotide
tatgtaagtcataggtaaaataggaggaacggtcagagaatctgcgtccccatcatgcgt

SEQ ID NO: 462 - DNA, 60 bp, Artificial Sequence
  Description of Artificial Sequence: Synthetic oligonucleotide
gaaacggctttacagaaaggagtaataattattgtagtctccctttttaatggtgagcaa

SEQ ID NO: 463 - DNA, 60 bp, Artificial Sequence
  Description of Artificial Sequence: Synthetic oligonucleotide
aaatgctagctctgtctgtttactagtgccatagctagcatgccaagcgatgagaatgat

SEQ ID NO: 464 - DNA, 60 bp, Artificial Sequence
  Description of Artificial Sequence: Synthetic oligonucleotide
tttgttatcctgtaatgaattgaatctgggcctattctgctcgcaccttcacacgtttgg

SEQ ID NO: 465 - DNA, 60 bp, Artificial Sequence
  Description of Artificial Sequence: Synthetic oligonucleotide
ttctatactaaaacatgacagcttgagcatcctcacttattaacgagtaactgttgtcac

SEQ ID NO: 466 - DNA, 60 bp, Artificial Sequence
  Description of Artificial Sequence: Synthetic oligonucleotide
acaatacataaatacctaaccaaaaacctgttagtccatgttttcccacatgtattttat

SEQ ID NO: 467 - DNA, 60 bp, Artificial Sequence
  Description of Artificial Sequence: Synthetic oligonucleotide
acggatgagacatcgtagttttatatttagtggactggccagctatattttcaaggatat

SEQ ID NO: 468 - DNA, 60 bp, Artificial Sequence
  Description of Artificial Sequence: Synthetic oligonucleotide
gatgtatgaggtacctattttcaaagttgtgatagcatatacatcataagatgtaatgtg

SEQ ID NO: 469 - DNA, 60 bp, Artificial Sequence
  Description of Artificial Sequence: Synthetic oligonucleotide
gatacatatgtgatcatcctgaagtgtgaattgtgtccaaaccttcatctcagtaatctt

SEQ ID NO: 470 - DNA, 60 bp, Artificial Sequence
  Description of Artificial Sequence: Synthetic oligonucleotide
atgctcttgaattaatttttgacgtcattttttgtgaatgtgttcgttcaatgtgacttc

SEQ ID NO: 471 - DNA, 60 bp, Artificial Sequence
  Description of Artificial Sequence: Synthetic oligonucleotide
tttaagctttgtgcatgtgttttgctcaacaactgtgaagattagaatctttataaccat

SEQ ID NO: 472 - DNA, 60 bp, Artificial Sequence
  Description of Artificial Sequence: Synthetic oligonucleotide
cttaaaggaccttgtcacttgttactcttgtaattgatcgtagggaatccttactctatt

SEQ ID NO: 473 - DNA, 60 bp, Artificial Sequence
  Description of Artificial Sequence: Synthetic oligonucleotide
atttgtatacgatttgcctttacgttttgtagcgatgtgggtgttatcgatgactattaa

SEQ ID NO: 474 - DNA, 60 bp, Artificial Sequence
  Description of Artificial Sequence: Synthetic oligonucleotide
atttcataacgatagaatcaatttatatactaaatagttcgtctactgtgaaatgataat

SEQ ID NO: 475 - DNA, 60 bp, Artificial Sequence
  Description of Artificial Sequence: Synthetic oligonucleotide
ttatgtttttcgtccgctataggctaagcacaggctatcgcaacccagtggattggataa

SEQ ID NO: 476 - DNA, 60 bp, Artificial Sequence
  Description of Artificial Sequence: Synthetic oligonucleotide
atattacaggaaacggttggatcgttttaaaatacgaaacgactgtcgttactatagtta

SEQ ID NO: 477 - DNA, 60 bp, Artificial Sequence
  Description of Artificial Sequence: Synthetic oligonucleotide
gagtgagaggttatggaaactgtgaatatatatcgcagtgagtgatgagtgagagattgt

SEQ ID NO: 478 - DNA, 60 bp, Artificial Sequence
  Description of Artificial Sequence: Synthetic oligonucleotide
tttcattcaacatcagctaagacgacgaaactcagaggaaatcttgtggtggataactaa

SEQ ID NO: 479 - DNA, 60 bp, Artificial Sequence
  Description of Artificial Sequence: Synthetic oligonucleotide
tattcactaagtaatggtagaaggtcaaggctctgttaatataagagtacaattcttgta

SEQ ID NO: 480 - DNA, 60 bp, Artificial Sequence
  Description of Artificial Sequence: Synthetic oligonucleotide
gaatgctttgctatagttctcttactcggagaacattcttacatggagaacgtgcagttt

SEQ ID NO: 481 - DNA, 60 bp, Artificial Sequence
  Description of Artificial Sequence: Synthetic oligonucleotide
attttgtaggggtatttcacaggctcttaggttggaattcgaatcacttgtgtgtgactt

SEQ ID NO: 482 - DNA, 60 bp, Artificial Sequence
  Description of Artificial Sequence: Synthetic oligonucleotide
aaatatggcagcgtctaatgaacagatgaaagagaatcgtgattgggttgattgccgtct

SEQ ID NO: 483 - DNA, 60 bp, Artificial Sequence
  Description of Artificial Sequence: Synthetic oligonucleotide
gacacccaagaggccgggtacgaacatcgagacctatatcttcgctcttttcaacgaaga

SEQ ID NO: 484 - DNA, 60 bp, Artificial Sequence
  Description of Artificial Sequence: Synthetic oligonucleotide
aatgcagtgatttatgttatggaggatgctacttatacaatcgtcctcctaaataaattc

SEQ ID NO: 485 - DNA, 60 bp, Artificial Sequence
  Description of Artificial Sequence: Synthetic oligonucleotide
gatttcaagtgggtaatatacaaatagtattttttgtactatgtctccaaatttacattt

SEQ ID NO: 486 - DNA, 60 bp, Artificial Sequence
  Description of Artificial Sequence: Synthetic oligonucleotide
gagatattaatcttatttttagttagttttctgatgtcagttaggtgtcatcacgattga

SEQ ID NO: 487 - DNA, 60 bp, Artificial Sequence
  Description of Artificial Sequence: Synthetic oligonucleotide
ggaaccgtagaaagctttaaaacgagctctgaaacgcctctgggtgctcggatataggat

SEQ ID NO: 488 - DNA, 60 bp, Artificial Sequence
  Description of Artificial Sequence: Synthetic oligonucleotide
agagtcctcatctgaatgcatcaaatggtgtaatattcttagtaggtatagctttaccct

SEQ ID NO: 489 - DNA, 60 bp, Artificial Sequence
  Description of Artificial Sequence: Synthetic oligonucleotide
aaatatctgggttacacagatattgatatagtggtggcagaaacgggatggccatctgca

SEQ ID NO: 490 - DNA, 60 bp, Artificial Sequence
  Description of Artificial Sequence: Synthetic oligonucleotide
gttgcgcgcaacagagtgcacgtatttggaaatcaatgcctctgcacagaacgttgtatc

SEQ ID NO: 491 - DNA, 60 bp, Artificial Sequence
  Description of Artificial Sequence: Synthetic oligonucleotide
ttattagtttggttctccgaaggcaattgtcaggaggcagattaaggttaggtaataaac

SEQ ID NO: 492 - DNA, 60 bp, Artificial Sequence
  Description of Artificial Sequence: Synthetic oligonucleotide
taactggaataaattattgtttactgtgtccccttatcagaaattgttgtcaacaactgc

SEQ ID NO: 493 - DNA, 60 bp, Artificial Sequence
  Description of Artificial Sequence: Synthetic oligonucleotide
ttatttgattacatgctttgtatttccatttctgtcattgtgaacccaagttattaagct

SEQ ID NO: 494 - DNA, 60 bp, Artificial Sequence
  Description of Artificial Sequence: Synthetic oligonucleotide
gcagtaggaataaaacttttaggaaagtttaggaatgtcaagctggttgtatatcattat

SEQ ID NO: 495 - DNA, 60 bp, Artificial Sequence
  Description of Artificial Sequence: Synthetic oligonucleotide
atttatttaagattagagtgatgctaacagctacaacttgtaaaagctcctggttgttgc

SEQ ID NO: 496 - DNA, 60 bp, Artificial Sequence
  Description of Artificial Sequence: Synthetic oligonucleotide
agatggtcatgctagttgtatgatgtgctcatacaatcagctaaatggagtccctgtatg

SEQ ID NO: 497 - DNA, 60 bp, Artificial Sequence
  Description of Artificial Sequence: Synthetic oligonucleotide
aattattgagcaacgactcctaaaaattgggtgtggttgctgtcgtgtagtgtaataatt

SEQ ID NO: 498 - DNA, 60 bp, Artificial Sequence
  Description of Artificial Sequence: Synthetic oligonucleotide
ctcctgaagtgtggaataaacttataagttatgacagaggacatcaccaggtttaaacag

SEQ ID NO: 499 - DNA, 60 bp, Artificial Sequence
  Description of Artificial Sequence: Synthetic oligonucleotide
atgtgggctacaagcaccatgatcccctgtttcccttggattttgaattgaccacaacag

SEQ ID NO: 500 - DNA, 60 bp, Artificial Sequence
  Description of Artificial Sequence: Synthetic oligonucleotide
catagatgatagaaccaattgtttgtaaaacagtagaataatcttgtactttatatctgg

SEQ ID NO: 501 - DNA, 60 bp, Artificial Sequence
  Description of Artificial Sequence: Synthetic oligonucleotide
gttatttaggcttacccgtctcttatttatttaataatggtcgcactgtgtaacaaattt

SEQ ID NO: 502 - DNA, 60 bp, Artificial Sequence
  Description of Artificial Sequence: Synthetic oligonucleotide
acagtagctgaaattccaagggagtaatttaggttcatctcttatttaaaagaatgaatg

SEQ ID NO: 503 - DNA, 60 bp, Artificial Sequence
  Description of Artificial Sequence: Synthetic oligonucleotide
ctgcgcgagcttagctcaataaatttggagtaatcttttttataccacctattaggtata

SEQ ID NO: 504 - DNA, 60 bp, Artificial Sequence
  Description of Artificial Sequence: Synthetic oligonucleotide
cagtgcgacacagtcggattatcaaaggtacggagatgcacagttacaagtatacggtga

SEQ ID NO: 505 - DNA, 60 bp, Artificial Sequence
  Description of Artificial Sequence: Synthetic oligonucleotide
gcatcagtggatgcgctcagggctccaatataactgtactggatagattatatacatcaa

SEQ ID NO: 506 - DNA, 60 bp, Artificial Sequence
  Description of Artificial Sequence: Synthetic oligonucleotide
ctgaaagacaatggtataaagaaggtgaaactgtttgatgcagaggagcgcgcgatgaga

SEQ ID NO: 507 - DNA, 60 bp, Artificial Sequence
  Description of Artificial Sequence: Synthetic oligonucleotide
attctgcagcttgtgagtccaacattcaaataaaaccgatgtggactggtcctcctctat

SEQ ID NO: 508 - DNA, 60 bp, Artificial Sequence
  Description of Artificial Sequence: Synthetic oligonucleotide
ccacatcacatgtgacccgagtcgatgtagacaagcccttatctgcagacaagcccttat

SEQ ID NO: 509 - DNA, 60 bp, Artificial Sequence
  Description of Artificial Sequence: Synthetic oligonucleotide
ttcattgttgtacgcagaatagaggtatcagagtttactgccattcattgataggtattc

SEQ ID NO: 510 - DNA, 60 bp, Artificial Sequence
  Description of Artificial Sequence: Synthetic oligonucleotide
atatctgtgtaattataaagtgaaaatagtgactgagactctggatacggccttatccag

SEQ ID NO: 511 - DNA, 60 bp, Artificial Sequence
  Description of Artificial Sequence: Synthetic oligonucleotide
gtaacgccatgcattcactataccaatgtgataaggacgtcactatactgctgtaatctg

SEQ ID NO: 512 - DNA, 60 bp, Artificial Sequence
  Description of Artificial Sequence: Synthetic oligonucleotide
aatcctacgatgtaacgttaggaaatctttcaaacggtatgtaacagatggataaaatta

SEQ ID NO: 513 - DNA, 60 bp, Artificial Sequence
  Description of Artificial Sequence: Synthetic oligonucleotide
aaagaccaatcaagtaaactgacaaccaaataagctccctacagtactgacaactctaga

SEQ ID NO: 514 - DNA, 60 bp, Artificial Sequence
  Description of Artificial Sequence: Synthetic oligonucleotide
ttctttcttaacacatttgagaacatggctagccattttaggctcgatactgtatcaatt

SEQ ID NO: 515 - DNA, 60 bp, Artificial Sequence
  Description of Artificial Sequence: Synthetic oligonucleotide
tctctttcatgtttatctcgagaattgtaggatataccacaggctacataatctctggtt

SEQ ID NO: 516 - DNA, 60 bp, Artificial Sequence
  Description of Artificial Sequence: Synthetic oligonucleotide
ttggaggtgctttattccattctcctagagttaggctgtcagctatatgatctattatat

SEQ ID NO: 517 - DNA, 60 bp, Artificial Sequence
  Description of Artificial Sequence: Synthetic oligonucleotide
tatgaatcgaattgagaatagtagcaatttaatttgctatcggacaatatgctcctaagt

SEQ ID NO: 518 - DNA, 60 bp, Artificial Sequence
  Description of Artificial Sequence: Synthetic oligonucleotide
atcctggtttaatccccaactggcatagagctttgacgagattcatatgcggcattaaat

SEQ ID NO: 519 - DNA, 60 bp, Artificial Sequence
  Description of Artificial Sequence: Synthetic oligonucleotide
attcctagccaattttagatgagaactactgatgaaatcttatagaagttgtaagaaccc

SEQ ID NO: 520 - DNA, 60 bp, Artificial Sequence
  Description of Artificial Sequence: Synthetic oligonucleotide
gtaaaatagagttaggagaatacattattatttcatatatgtctatttcattatatgttt

SEQ ID NO: 521 - DNA, 60 bp, Artificial Sequence
  Description of Artificial Sequence: Synthetic oligonucleotide
ttctcagacacacatgtaaaatattagagggtatcaatcatttcattttggtactgctat

SEQ ID NO: 522 - DNA, 60 bp, Artificial Sequence
  Description of Artificial Sequence: Synthetic oligonucleotide
cagaaacgcatgtaacacaatcgattcattttgggtactggtaatacaaaatcgagattc

SEQ ID NO: 523 - DNA, 60 bp, Artificial Sequence
  Description of Artificial Sequence: Synthetic oligonucleotide
agcattcctgactcaagtactcggtcgtctgattgatgtattttagatgcgctgtccttc

SEQ ID NO: 524 - DNA, 60 bp, Artificial Sequence
  Description of Artificial Sequence: Synthetic oligonucleotide
tgactcaactctgtcgcctgattgacgtattttagatgccttcttctttgaaccattctt

SEQ ID NO: 525 - DNA, 60 bp, Artificial Sequence
  Description of Artificial Sequence: Synthetic oligonucleotide
agcactctcgactcaactcctcgtctaattgatgaattctagatgccctgcccttacaag

SEQ ID NO: 526 - DNA, 60 bp, Artificial Sequence
  Description of Artificial Sequence: Synthetic oligonucleotide
gcaactactattacatatttctacatatacaggagtgtaccaatcaaagggaatgagtgg

SEQ ID NO: 527 - DNA, 60 bp, Artificial Sequence
  Description of Artificial Sequence: Synthetic oligonucleotide
aattgattcacgtgattaatccatcttatcgagttcgaaaaccattgatcgagttcgtat

SEQ ID NO: 528 - DNA, 60 bp, Artificial Sequence
  Description of Artificial Sequence: Synthetic oligonucleotide
gagggcgatacagagtcaattacaagtattcccctttcgttgtcacgctagctaacctta

SEQ ID NO: 529 - DNA, 60 bp, Artificial Sequence
  Description of Artificial Sequence: Synthetic oligonucleotide
tccgctgctgtgatgatggtggtattagaccatacgattgtaattctacgcagttattat

SEQ ID NO: 530 - DNA, 60 bp, Artificial Sequence
  Description of Artificial Sequence: Synthetic oligonucleotide
aggaatctcaatcttgtgttacagagatacacagggaacagtagccttgaataaagctgg

SEQ ID NO: 531 - DNA, 60 bp, Artificial Sequence
  Description of Artificial Sequence: Synthetic oligonucleotide
tgctgtccagggcacaattggacttgtaaattgccatccacgacacaatatttacctatt

SEQ ID NO: 532 - DNA, 60 bp, Artificial Sequence
  Description of Artificial Sequence: Synthetic oligonucleotide
gttatttatgtcatcgttactgttttgcagtcacaagatgacttatctctgtaatgcttg

SEQ ID NO: 533 - DNA, 60 bp, Artificial Sequence
  Description of Artificial Sequence: Synthetic oligonucleotide
ggctgttctaattatgttataactgccatttcgtagtaacaaaatggcttatgtgtgtgg

SEQ ID NO: 534 - DNA, 60 bp, Artificial Sequence
  Description of Artificial Sequence: Synthetic oligonucleotide
aacacgatgatctcactctcatattttctccgccggtttgaacaagaagctaaaaatccg

SEQ ID NO: 535 - DNA, 60 bp, Artificial Sequence
  Description of Artificial Sequence: Synthetic oligonucleotide
aactcgaagaaccatctcgaacagtcaattaaattattaagatagacctgcattgaaaag

SEQ ID NO: 536 - DNA, 60 bp, Artificial Sequence
  Description of Artificial Sequence: Synthetic oligonucleotide
atcggccactccccacataagtattaggctatgttctgtaattgtgaattttcgaaatat

SEQ ID NO: 537 - DNA, 60 bp, Artificial Sequence
  Description of Artificial Sequence: Synthetic oligonucleotide
aatcttaatgtatgccgttgaggttggattcctttccgattccattaaaatcctattcta

SEQ ID NO: 538 - DNA, 60 bp, Artificial Sequence
  Description of Artificial Sequence: Synthetic oligonucleotide
ttgttagcgatgatggacgccatcagcatcttatgctaccgtcggactatcaaatgtttg

SEQ ID NO: 539 - DNA, 60 bp, Artificial Sequence
  Description of Artificial Sequence: Synthetic oligonucleotide
attttgcaaatagatcaaaattgaagataaggcgcgtgtctaatttaatgtagcacccaa

SEQ ID NO: 540 - DNA, 60 bp, Artificial Sequence
  Description of Artificial Sequence: Synthetic oligonucleotide
gttccacttgtattagttttagtagagtcctgtgcattcctgatagcttggatagtgaaa

SEQ ID NO: 541 - DNA, 60 bp, Artificial Sequence
  Description of Artificial Sequence: Synthetic oligonucleotide
ttggtaataagacagtctggtggaggagaggcactttccattaccggatgctacagaacc

SEQ ID NO: 542 - DNA, 60 bp, Artificial Sequence
  Description of Artificial Sequence: Synthetic oligonucleotide
atatcagtggattcatgcggtattcggcgctacaagtgtatataagtatatcctgtaagc

SEQ ID NO: 543 - DNA, 60 bp, Artificial Sequence
  Description of Artificial Sequence: Synthetic oligonucleotide
acgttttgaaacccacgggattcattgtaggtcaacatatatcatgcatgttcctaaaat

SEQ ID NO: 544 - DNA, 60 bp, Artificial Sequence
  Description of Artificial Sequence: Synthetic oligonucleotide
tttatttatggccatctataatataggccattgaagagtgcttctgtatgggtgtgtaag

SEQ ID NO: 545 - DNA, 60 bp, Artificial Sequence
  Description of Artificial Sequence: Synthetic oligonucleotide
aaaggagctcacatctaagcgcgagtatgtatgaagtgtaggatgatttacatgtgagaa

SEQ ID NO: 546 - DNA, 60 bp, Artificial Sequence
  Description of Artificial Sequence: Synthetic oligonucleotide
gccgtcatatagataaccacaaccttaagaacggacgccatatagaaatgaattagtcag

SEQ ID NO: 547 - DNA, 60 bp, Artificial Sequence
  Description of Artificial Sequence: Synthetic oligonucleotide
gagctcgttcattattaccagtgggcttgttattcgaccttcggattatcgaatgtttgg

SEQ ID NO: 548 - DNA, 59 bp, Artificial Sequence
  Description of Artificial Sequence: Synthetic oligonucleotide
tacaatctgtatttacactgttgtattagaaaggctgtcaccaacgggagccaataaaa

SEQ ID NO: 549 - DNA, 60 bp, Artificial Sequence
  Description of Artificial Sequence: Synthetic oligonucleotide
atagactggaatgacgctccctttattgcctcttatcaatcgtttgaagtcgatgcatgc

SEQ ID NO: 550 - DNA, 60 bp, Artificial Sequence
  Description of Artificial Sequence: Synthetic oligonucleotide
gatatagcttaaaccttttcgtaatctttgtaccattataaaatgctgcgtgctgctcat

SEQ ID NO: 551 - DNA, 60 bp, Artificial Sequence
  Description of Artificial Sequence: Synthetic oligonucleotide
aagtatttaatatatggattagtagggaatatctaattctatattcatagaaagtagata

SEQ ID NO: 552 - DNA, 60 bp, Artificial Sequence
  Description of Artificial Sequence: Synthetic oligonucleotide
gggtttatgtagttcttttgttacccatacaactagctctgttttacgtttagatgtaat

SEQ ID NO: 553 - DNA, 60 bp, Artificial Sequence
  Description of Artificial Sequence: Synthetic oligonucleotide
ttgtggcgttatgcttttttcgctatacctatgtagtacgaaacccttagtgttatgatc

SEQ ID NO: 554 - DNA, 60 bp, Artificial Sequence
  Description of Artificial Sequence: Synthetic oligonucleotide
ttttccttagtgctataaataaagtcccgagggcacccggattataaagccccgaaggca

SEQ ID NO: 555 - DNA, 60 bp, Artificial Sequence
  Description of Artificial Sequence: Synthetic oligonucleotide
tgtagggtatatttctttatgttctgtccacctgcctgcgtggctttctagcgtatactt

SEQ ID NO: 556 - DNA, 60 bp, Artificial Sequence
  Description of Artificial Sequence: Synthetic oligonucleotide
tcttcatgttccgtgcatctgtttgcgtggttatgtagtgtataatttcgtgatgcttgt

SEQ ID NO: 557 - DNA, 60 bp, Artificial Sequence
  Description of Artificial Sequence: Synthetic oligonucleotide
ttttgcttacccatattgtagttcgattttgtggaaactcctcggcagtctattaaatat

SEQ ID NO: 558 - DNA, 60 bp, Artificial Sequence
  Description of Artificial Sequence: Synthetic oligonucleotide
cttcggttttgcgtttctatgttcatctaatttgaattagtgtattccatacggcatatg

SEQ ID NO: 559 - DNA, 60 bp, Artificial Sequence
  Description of Artificial Sequence: Synthetic oligonucleotide
gaggttcggtgtctataagtctaggttccgattctgcaagtctagaggtttactctcatg

SEQ ID NO: 560 - DNA, 60 bp, Artificial Sequence
  Description of Artificial Sequence: Synthetic oligonucleotide
acattaaaccatagttactaaattcgaattcgaattcgaattcggattcgaattcgatac

SEQ ID NO: 561 - DNA, 60 bp, Artificial Sequence
  Description of Artificial Sequence: Synthetic oligonucleotide
gaatctccaatagtgttgctgtttagctttagagtaatgtaatccacccatatccaataa

SEQ ID NO: 562 - DNA, 60 bp, Artificial Sequence
  Description of Artificial Sequence: Synthetic oligonucleotide
tcctgcccgctcttcgtttcttacatcgattttagtgttccactctacgagtatgtgctt

SEQ ID NO: 563 - DNA, 60 bp, Artificial Sequence
  Description of Artificial Sequence: Synthetic oligonucleotide
ggtgtaatggccgcccactgctctttgaaaatagcctgtggcataacatcatttgtgtga

SEQ ID NO: 564 - DNA, 60 bp, Artificial Sequence
  Description of Artificial Sequence: Synthetic oligonucleotide
tcatgttttgctaccggaaacgttttttcatgtaacgatggaatatcaacagctgtttta

SEQ ID NO: 565 - DNA, 60 bp, Artificial Sequence
  Description of Artificial Sequence: Synthetic oligonucleotide
atctatttagtagctattagcaaataagttaggagtgtttattgtgagattttaggggga

SEQ ID NO: 566 - DNA, 60 bp, Artificial Sequence
  Description of Artificial Sequence: Synthetic oligonucleotide
ttcttctaactaagtacctactaaataaggtcatggtatgatcaataacggataagggtg

SEQ ID NO: 567 - DNA, 60 bp, Artificial Sequence
  Description of Artificial Sequence: Synthetic oligonucleotide
tctcaataataatgccgtgattataaagtccggcgatataactataacttgtttgtatgt

SEQ ID NO: 568 - DNA, 60 bp, Artificial Sequence
  Description of Artificial Sequence: Synthetic oligonucleotide
cctactatggtttatcataggtcaatgttatggtactattgaactgatgaggttagggat

SEQ ID NO: 569 - DNA, 60 bp, Artificial Sequence
  Description of Artificial Sequence: Synthetic oligonucleotide
gttattattatacgtcgtactgattcgttattattataagtttcatacctgctttatttc

SEQ ID NO: 570 - DNA, 60 bp, Artificial Sequence
  Description of Artificial Sequence: Synthetic oligonucleotide
ggcaggttaaatcttctttttagatgttaagagtttgaaatttgattaatcataaaggtt

SEQ ID NO: 571 - DNA, 60 bp, Artificial Sequence
  Description of Artificial Sequence: Synthetic oligonucleotide
cataatccaattgtttgaggcatagggctgagattgttttctaattggctagcatagtaa

SEQ ID NO: 572 - DNA, 60 bp, Artificial Sequence
  Description of Artificial Sequence: Synthetic oligonucleotide
ttgtttatcaccacattaaccaaccttacaagcgtttacccttctagatgtagcaaggtt

SEQ ID NO: 573 - DNA, 60 bp, Artificial Sequence
  Description of Artificial Sequence: Synthetic oligonucleotide
atggtaactttagaaactggcatcctgtcaggagaacaaatgtcgtttagtgtatgcata

SEQ ID NO: 574 - DNA, 60 bp, Artificial Sequence
  Description of Artificial Sequence: Synthetic oligonucleotide
tgatacggattgtcctccgggtatccatgtagctttatatgaggatgacgcgttattatc

SEQ ID NO: 575 - DNA, 60 bp, Artificial Sequence
  Description of Artificial Sequence: Synthetic oligonucleotide
tccttatgtctacttatgtcgcccgtgataactactaaagtatgttgtgtgtgcaaggta

SEQ ID NO: 576 - DNA, 60 bp, Artificial Sequence
  Description of Artificial Sequence: Synthetic oligonucleotide
aaaacacaatatgtattagtggcatgcactggtggaaacactggtaccatttaaccatta

SEQ ID NO: 577 - DNA, 60 bp, Artificial Sequence
  Description of Artificial Sequence: Synthetic oligonucleotide
aaggagttttacgtactaatagatatgggggacaatacaagcatattgagttgtacgatc

SEQ ID NO: 578 - DNA, 60 bp, Artificial Sequence
  Description of Artificial Sequence: Synthetic oligonucleotide
tgaaaattaatgttgcgtggaataaggtctgttgaaaattaaatgcagcgtggagaaaag

SEQ ID NO: 579 - DNA, 60 bp, Artificial Sequence
  Description of Artificial Sequence: Synthetic oligonucleotide
tgctgctctgtaatattgatatacactttgcgtatatttctgcgctgagtcaggatggtg

SEQ ID NO: 580 - DNA, 60 bp, Artificial Sequence
  Description of Artificial Sequence: Synthetic oligonucleotide
catttactgtatgttgccgcgctgactcgacgcggtgatatattgtatcagtgatatatt

SEQ ID NO: 581 - DNA, 60 bp, Artificial Sequence
  Description of Artificial Sequence: Synthetic oligonucleotide
ttctgattgttgctggtgaatagaattgatatgtacatcgtgtgctcacttgggacagta

SEQ ID NO: 582 - DNA, 60 bp, Artificial Sequence
  Description of Artificial Sequence: Synthetic oligonucleotide
tctggcattcaaatcatggaagaaaccacctgtgggccttctagccaatttggggactgc

SEQ ID NO: 583 - DNA, 60 bp, Artificial Sequence
  Description of Artificial Sequence: Synthetic oligonucleotide
gagattcaggtgtatgtctccgtgcaagttcagtgcctggcttgttataggagctgtgag

SEQ ID NO: 584 - DNA, 60 bp, Artificial Sequence
  Description of Artificial Sequence: Synthetic oligonucleotide
ttgggtggttgcgggtttcgaactccgaatctattgattcatcggttctaaaagaaccag

SEQ ID NO: 585 - DNA, 60 bp, Artificial Sequence
  Description of Artificial Sequence: Synthetic oligonucleotide
aagtactaatacggccgggactgtatcaccagatctcagattcctagcaagctgcaacga

SEQ ID NO: 586 - DNA, 60 bp, Artificial Sequence
  Description of Artificial Sequence: Synthetic oligonucleotide
aagaagctaatggggaaacccagatcgctttgactttgaatcatcgttgtagagaagtca

SEQ ID NO: 587 - DNA, 60 bp, Artificial Sequence
  Description of Artificial Sequence: Synthetic oligonucleotide
ccctcgtaatcatttttaagtgattcatgaattctactttatatatcgattgattgttat

SEQ ID NO: 588 - DNA, 60 bp, Artificial Sequence
  Description of Artificial Sequence: Synthetic oligonucleotide
catttgaattaatgaatgtgtcattggggatgacgtggtgactcgtactgtcgacaccct

SEQ ID NO: 589 - DNA, 60 bp, Artificial Sequence
  Description of Artificial Sequence: Synthetic oligonucleotide
accgctctgtttaacagtggggccacttgtggggcatgcttccagatacagtgtgatata

SEQ ID NO: 590 - DNA, 60 bp, Artificial Sequence
  Description of Artificial Sequence: Synthetic oligonucleotide
tatgtaatttatggaccgcaattttgtgttttattaaatgaattacatatcgcacagaca

SEQ ID NO: 591 - DNA, 60 bp, Artificial Sequence
  Description of Artificial Sequence: Synthetic oligonucleotide
ttgtcttgtcattgggaggttattgcatttgaatactcatggcaagggtttggtgtactt

SEQ ID NO: 592 - DNA, 60 bp, Artificial Sequence
  Description of Artificial Sequence: Synthetic oligonucleotide
aggtatccaaacaagtgaagactataggttctatgccatatcagctgagtaccccgaatt

SEQ ID NO: 593 - DNA, 60 bp, Artificial Sequence
  Description of Artificial Sequence: Synthetic oligonucleotide
gaaatatagagtcagcacgggaatatagttggatgtctatcctgtgtctccgaatggttc

SEQ ID NO: 594 - DNA, 60 bp, Artificial Sequence
  Description of Artificial Sequence: Synthetic oligonucleotide
aatctgaatactatgtagaagtctaggttatcctggattacgtctcgaaatgttgtgttg

SEQ ID NO: 595 - DNA, 60 bp, Artificial Sequence
  Description of Artificial Sequence: Synthetic oligonucleotide
ctctgacaagttgacacacttgtacactgctatcatcaaccccgaccagacctacgagat

SEQ ID NO: 596 - DNA, 60 bp, Artificial Sequence
  Description of Artificial Sequence: Synthetic oligonucleotide
acgacgtgagaggggttatgatcgacgatatcgagatagatacagagataaatatagaag

SEQ ID NO: 597 - DNA, 60 bp, Artificial Sequence
  Description of Artificial Sequence: Synthetic oligonucleotide
gttgggtttacctgacaccggtgggcaggttgtttacatactggatcaagttcgtgcctt

SEQ ID NO: 598 - DNA, 60 bp, Artificial Sequence
  Description of Artificial Sequence: Synthetic oligonucleotide
ggtttacctgacaccggtgggcaggtgattgcttgttcatcttggttgtttacatactgg

SEQ ID NO: 599 - DNA, 60 bp, Artificial Sequence
  Description of Artificial Sequence: Synthetic oligonucleotide
ccccatggtctttaacgttgttatcatgtcacctcacggttactttgcccaagacgacgt

SEQ ID NO: 600 - DNA, 60 bp, Artificial Sequence
  Description of Artificial Sequence: Synthetic oligonucleotide
gaatttagtagcgtcacttatggctagtaaactcgggacaactcagggaacaattgcgca

SEQ ID NO: 601 - DNA, 60 bp, Artificial Sequence
  Description of Artificial Sequence: Synthetic oligonucleotide
tgttgcttactcgttagccaaaaaattaggtgttacacagtgcacaatagcacatgccct

SEQ ID NO: 602 - DNA, 60 bp, Artificial Sequence
  Description of Artificial Sequence: Synthetic oligonucleotide
tttagttgtaaagcccttccttcttatatttataggtgtaatacaaatacatatatgtag

SEQ ID NO: 603 - DNA, 60 bp, Artificial Sequence
  Description of Artificial Sequence: Synthetic oligonucleotide
aaggtacccctgctaagccatcggtgcctattgacatatacgtgtttgcgctatttaacg

SEQ ID NO: 604 - DNA, 60 bp, Artificial Sequence
  Description of Artificial Sequence: Synthetic oligonucleotide
cttcaataattcctagatgccaatgtactgtcattttattgctattctattccaaaatgt

SEQ ID NO: 605 - DNA, 60 bp, Artificial Sequence
  Description of Artificial Sequence: Synthetic oligonucleotide
actttgtatccggtcaattccgatagtttcgtcacgtcatcgatatggatttatgcctat

SEQ ID NO: 606 - DNA, 60 bp, Artificial Sequence
  Description of Artificial Sequence: Synthetic oligonucleotide
tctggccttttcctcgacctaagcaaaaagctcgactttttgtgtcgagagaaatggtcc

SEQ ID NO: 607 - DNA, 60 bp, Artificial Sequence
  Description of Artificial Sequence: Synthetic oligonucleotide
attctagtaaatccgcattaaatctctataaatctccgcgtctttcgacactacatccga

SEQ ID NO: 608 - DNA, 60 bp, Artificial Sequence
  Description of Artificial Sequence: Synthetic oligonucleotide
cttcagatatagtagcagtcttaaaatccaatgagataactcatgtgcgactttacaatg

SEQ ID NO: 609 - DNA, 60 bp, Artificial Sequence
  Description of Artificial Sequence: Synthetic oligonucleotide
ttggtaagcccgagttaatactggggagtggaattaccattcatgtaattcgcctagata

SEQ ID NO: 610 - DNA, 60 bp, Artificial Sequence
  Description of Artificial Sequence: Synthetic oligonucleotide
tcgataggaccggaactcctttgcacccagaacttacttctagtgtgtatatatacgaat

SEQ ID NO: 611 - DNA, 60 bp, Artificial Sequence
  Description of Artificial Sequence: Synthetic oligonucleotide
tcttccactacttgtagcaagcgttgtccatatttgagagatatgacacttatgtttttc

SEQ ID NO: 612 - DNA, 60 bp, Artificial Sequence
  Description of Artificial Sequence: Synthetic oligonucleotide
agattgggtgagaactaatgtcgagccttatgttcccgccaccgatattgtccgaatttt

SEQ ID NO: 613 - DNA, 60 bp, Artificial Sequence
  Description of Artificial Sequence: Synthetic oligonucleotide
ataaaccacggcgtttgggctaacgacggagaaaatacccgctacccccacccaataata

SEQ ID NO: 614 - DNA, 60 bp, Artificial Sequence
  Description of Artificial Sequence: Synthetic oligonucleotide
agtcatagaagtcaggtcactataatacttagacaatacgcaggattaccctagtatatg

SEQ ID NO: 615 - DNA, 60 bp, Artificial Sequence
  Description of Artificial Sequence: Synthetic oligonucleotide
atttgctatcaatccatatccctatttcgcatacaggagcgatcctaggccagagacatt

SEQ ID NO: 616 - DNA, 60 bp, Artificial Sequence
  Description of Artificial Sequence: Synthetic oligonucleotide
tttcttttttgctaggtaaatataagattgcgtaacttctaaagaaagttacatgggaac

SEQ ID NO: 617 - DNA, 60 bp, Artificial Sequence
  Description of Artificial Sequence: Synthetic oligonucleotide
ctgattgtgttgacggtgatctcgatggcttatacctttttgttacagtagttttgattg

SEQ ID NO: 618 - DNA, 60 bp, Artificial Sequence
  Description of Artificial Sequence: Synthetic oligonucleotide
tttttaaatcggacttttctagcataacagtctttaggcgactataagaataatggtttg

SEQ ID NO: 619 - DNA, 60 bp, Artificial Sequence
  Description of Artificial Sequence: Synthetic oligonucleotide
tataataggaaacagtgacctagataatgggactaatgaatggttcccccttggtaactg

SEQ ID NO: 620 - DNA, 60 bp, Artificial Sequence
  Description of Artificial Sequence: Synthetic oligonucleotide
tgattgatagttgctaaattaagattaatcagagagggtacatataagggcccttaaatg

SEQ ID NO: 621 - DNA, 60 bp, Artificial Sequence
  Description of Artificial Sequence: Synthetic oligonucleotide
gaaatctctaatgattgtataagcataggattcccagtgacaagagaactagtcatgcct

SEQ ID NO: 622 - DNA, 60 bp, Artificial Sequence
  Description of Artificial Sequence: Synthetic oligonucleotide
tatcaatacttttgtaaaagtattaatttgtatttggttgtatcaaagttacaatctatt

SEQ ID NO: 623 - DNA, 60 bp, Artificial Sequence
  Description of Artificial Sequence: Synthetic oligonucleotide
atgacgtggtatccgcaatcatacgtggacgccgtcccaatgacaaatatgaacatgagg

SEQ ID NO: 624 - DNA, 60 bp, Artificial Sequence
  Description of Artificial Sequence: Synthetic oligonucleotide
gccgagccgttaagagtgatctagtcttgagaggaattcgcaaattttgggggcgtcatc

SEQ ID NO: 625 - DNA, 60 bp, Artificial Sequence
  Description of Artificial Sequence: Synthetic oligonucleotide
agtatggacacgggcttagctacacagaatattcttataagttcatatctgttaccaggg

SEQ ID NO: 626 - DNA, 60 bp, Artificial Sequence
  Description of Artificial Sequence: Synthetic oligonucleotide
tgatgacctgactaaacaggtgcagaacaacgtaatcccgatgagtcggatcgacgatgc

SEQ ID NO: 627 - DNA, 60 bp, Artificial Sequence
  Description of Artificial Sequence: Synthetic oligonucleotide
tttcgggtgggcgtatcggtcttataagtgccactacgatacctggagtctcgaacagat

SEQ ID NO: 628 - DNA, 60 bp, Artificial Sequence
  Description of Artificial Sequence: Synthetic oligonucleotide
gttggttgcaagtcgcatagagaattagcacgtgaagcagttcgaaagtcgttggtattg

SEQ ID NO: 629 - DNA, 60 bp, Artificial Sequence
  Description of Artificial Sequence: Synthetic oligonucleotide
cgtggtttagaacggttgaacaactgcccatggaccataaagctaattcttacgatccct

SEQ ID NO: 630 - DNA, 60 bp, Artificial Sequence
  Description of Artificial Sequence: Synthetic oligonucleotide
tgtaatattgccatattggcatggataatgataagcagttaaggcagtatggttgcgata

SEQ ID NO: 631 - DNA, 60 bp, Artificial Sequence
  Description of Artificial Sequence: Synthetic oligonucleotide
accaccgctcctgttaagaggaactaaactaggaattcaatggggacatttacactgttt

SEQ ID NO: 632 - DNA, 60 bp, Artificial Sequence
  Description of Artificial Sequence: Synthetic oligonucleotide
ccatatatatcttcaattgatgccctagtggcagcatggttaccgggcactgaaggtcag

SEQ ID NO: 633 - DNA, 60 bp, Artificial Sequence
  Description of Artificial Sequence: Synthetic oligonucleotide
agaccgggtcgtacctaatggttaatgtctacccgtttttcgcttacacggccaattcgg

SEQ ID NO: 634 - DNA, 60 bp, Artificial Sequence
  Description of Artificial Sequence: Synthetic oligonucleotide
atctgaccatgagttatgacattggtcttgcgaagagtagccagaccccagtgactccga

SEQ ID NO: 635 - DNA, 60 bp, Artificial Sequence
  Description of Artificial Sequence: Synthetic oligonucleotide
atgtatacccttactatgactacatgcaatccaatggtgtcattcccttagattatgcac

SEQ ID NO: 636 - DNA, 60 bp, Artificial Sequence
  Description of Artificial Sequence: Synthetic oligonucleotide
tctctttcattatgctttaggtaagatgttgttaggcaattgtagtgttgcagtcatcaa

SEQ ID NO: 637 - DNA, 60 bp, Artificial Sequence
  Description of Artificial Sequence: Synthetic oligonucleotide
gcatctcccagaagatctgaaataaagaggatccctctggtttgcgttgtaatcttcaag

SEQ ID NO: 638 - DNA, 60 bp, Artificial Sequence
  Description of Artificial Sequence: Synthetic oligonucleotide
gattgtagtaaggcattgtggcttcgttataggtgctgtctgacacttcgtacacagtta

SEQ ID NO: 639 - DNA, 60 bp, Artificial Sequence
  Description of Artificial Sequence: Synthetic oligonucleotide
ctaaaagctcagaacatacgacatgttaggctttatgacactgatcacgccatgctcctt

SEQ ID NO: 640 - DNA, 60 bp, Artificial Sequence
  Description of Artificial Sequence: Synthetic oligonucleotide
ccagaaatgcttgaggctcatataagttacggtgcgatgggaacccttctcgtgattaag

SEQ ID NO: 641 - DNA, 60 bp, Artificial Sequence
  Description of Artificial Sequence: Synthetic oligonucleotide
tttcctgattgggttttacgacgagaaggagtttgccttatacgtctcttccatatcgaa

SEQ ID NO: 642 - DNA, 60 bp, Artificial Sequence
  Description of Artificial Sequence: Synthetic oligonucleotide
tgtgacagtaagattttcaggcaagtaaagtagagcatatgcttagggtctgtattctat

SEQ ID NO: 643 - DNA, 60 bp, Artificial Sequence
  Description of Artificial Sequence: Synthetic oligonucleotide
tcttgagcaaaatccagtaattcctatcccgtaccttccatggttccctttagtcaagga

SEQ ID NO: 644 - DNA, 60 bp, Artificial Sequence
  Description of Artificial Sequence: Synthetic oligonucleotide
ctatctggggctcttaacgtaccaatgctatttactggtcactcacttggtcgagataag

SEQ ID NO: 645 - DNA, 60 bp, Artificial Sequence
  Description of Artificial Sequence: Synthetic oligonucleotide
tgattagttcagacaagactcctaacaagagacatttaccgcgcatatggtctgaggtga

SEQ ID NO: 646 - DNA, 60 bp, Artificial Sequence
  Description of Artificial Sequence: Synthetic oligonucleotide
tcttaagctaatcgacaaatataatctatatggccaagtatcgtatccaaagcaccataa

SEQ ID NO: 647 - DNA, 60 bp, Artificial Sequence
  Description of Artificial Sequence: Synthetic oligonucleotide
agaagatagatattggatgctatattgttgttgcttaagttatgttttaccactattcgt

SEQ ID NO: 648 - DNA, 60 bp, Artificial Sequence
  Description of Artificial Sequence: Synthetic oligonucleotide
ttttccgtttttcttaggaacttagtactttctttcgtttatatcgaagtagtccctctt

SEQ ID NO: 649 - DNA, 60 bp, Artificial Sequence
  Description of Artificial Sequence: Synthetic oligonucleotide
cttcagtcctcacttctcatattatcccattgagatttacttctcttcagcgagtacagc

SEQ ID NO: 650 - DNA, 60 bp, Artificial Sequence
  Description of Artificial Sequence: Synthetic oligonucleotide
cttcttcgctttgtagagctgcgcttcttctcatggtcgtttcttgggcgacttctgctt

SEQ ID NO: 651 - DNA, 60 bp, Artificial Sequence
  Description of Artificial Sequence: Synthetic oligonucleotide
cccctttgtgagccaactctattcattagttaatctccctctcgatgtactcgagaagca

SEQ ID NO: 652 - DNA, 60 bp, Artificial Sequence
  Description of Artificial Sequence: Synthetic oligonucleotide
tttgtggccgagaagcaattgatattcttttattcgttgacgattgtaacattcctatct

SEQ ID NO: 653 - DNA, 60 bp, Artificial Sequence
  Description of Artificial Sequence: Synthetic oligonucleotide
ggtgaaatatattttaaagcgaatcatctcttactgcgacttgtcgatagcttccggctc

SEQ ID NO: 654 - DNA, 60 bp, Artificial Sequence
  Description of Artificial Sequence: Synthetic oligonucleotide
gccaaagtataagccaaagtatagagcaatcatggcccatgaaggtggaggtcctagtgc

SEQ ID NO: 655 - DNA, 60 bp, Artificial Sequence
  Description of Artificial Sequence: Synthetic oligonucleotide
tcatcgtagcttggctacgaaacctagcccgcacctatttatcaatcccgtgaacccctt

SEQ ID NO: 656 - DNA, 60 bp, Artificial Sequence
  Description of Artificial Sequence: Synthetic oligonucleotide
gagcaatttggccacgtaaagagtgtattagcttatcgtataagaaagtcccatcttact

SEQ ID NO: 657 - DNA, 60 bp, Artificial Sequence
  Description of Artificial Sequence: Synthetic oligonucleotide
atatgtgtaattcgttttgtaagttcgcattattcattgatttctattcagttaatagat

SEQ ID NO: 658 - DNA, 60 bp, Artificial Sequence
  Description of Artificial Sequence: Synthetic oligonucleotide
tggatttatatgggttcatgggggtggggtatgtgtatagttcatgataccgatagagtt

SEQ ID NO: 659 - DNA, 60 bp, Artificial Sequence
  Description of Artificial Sequence: Synthetic oligonucleotide
aaggcgatattggatattgacgttgggtcgacagatttcgcggcagatttcgtgtatagt

SEQ ID NO: 660 - DNA, 60 bp, Artificial Sequence
  Description of Artificial Sequence: Synthetic oligonucleotide
acatggtctataactattgccgagactcgagaagggaccattcgctcactccagagtgca

SEQ ID NO: 661 - DNA, 60 bp, Artificial Sequence
  Description of Artificial Sequence: Synthetic oligonucleotide
aatgggtcaggagatatcacatgatatatgactattgccaggacaatgcaaggttccaaa

SEQ ID NO: 662 - DNA, 60 bp, Artificial Sequence
  Description of Artificial Sequence: Synthetic oligonucleotide
tccgactccgaagcgcgtgctgctcttttggtctcttcagatttaagtcaaagacaggct

SEQ ID NO: 663 - DNA, 60 bp, Artificial Sequence
  Description of Artificial Sequence: Synthetic oligonucleotide
ccacacttactctgtcctttggaaccctgtacacgtcgtgtactatgtcgatgggattcc

SEQ ID NO: 664 - DNA, 60 bp, Artificial Sequence
  Description of Artificial Sequence: Synthetic oligonucleotide
ggaggcaaataccctgtgaactacaagtatgcaccattcgtggtctccttagcagagacg

SEQ ID NO: 665 - DNA, 60 bp, Artificial Sequence
  Description of Artificial Sequence: Synthetic oligonucleotide
tcatctcaatgtttactatgtatattattgattgtcaatatgtgtaatcataagtcacct

SEQ ID NO: 666 - DNA, 60 bp, Artificial Sequence
  Description of Artificial Sequence: Synthetic oligonucleotide
tcatttcttccgatatgtatcaacatgggttcttcagcgcgaagatcaagttgccgtccg

SEQ ID NO: 667 - DNA, 60 bp, Artificial Sequence
  Description of Artificial Sequence: Synthetic oligonucleotide
ctactctttgttctggaaccggcgttatatcacgtttctggtcgatggaattcctataag

SEQ ID NO: 668 - DNA, 60 bp, Artificial Sequence
  Description of Artificial Sequence: Synthetic oligonucleotide
tacatcgttctagttgtgtgcggatgctctatcgtttccaatttggttatgctctacgtg

SEQ ID NO: 669 - DNA, 60 bp, Artificial Sequence
  Description of Artificial Sequence: Synthetic oligonucleotide
attgtctagagtaatgtaattttctgatgtgaattctttctattctagaactgaatgcac

SEQ ID NO: 670 - DNA, 60 bp, Artificial Sequence
  Description of Artificial Sequence: Synthetic oligonucleotide
gtagtggattcattatagcgtcaacgttgttaggatacaagggaaggtaatgtgcgcaac

SEQ ID NO: 671 - DNA, 60 bp, Artificial Sequence
  Description of Artificial Sequence: Synthetic oligonucleotide
tacaacgtctacgtgttgcactattgacgtttggtgatgtgatcatgatcggtttacttt

SEQ ID NO: 672 - DNA, 60 bp, Artificial Sequence
  Description of Artificial Sequence: Synthetic oligonucleotide
ttggtttattaagtcattcgacatgtagtgagcagtcgtttgattcgattgattagaccg

SEQ ID NO: 673 - DNA, 60 bp, Artificial Sequence
  Description of Artificial Sequence: Synthetic oligonucleotide
ctgtagttgaatataaggtcatagctatgcattactagacacttagtagatacatcatgg

SEQ ID NO: 674 - DNA, 60 bp, Artificial Sequence
  Description of Artificial Sequence: Synthetic oligonucleotide
ggatgttgtgtgctccgtctgggcactaataaataaaacgtactctataaggatccgtct

SEQ ID NO: 675 - DNA, 60 bp, Artificial Sequence
  Description of Artificial Sequence: Synthetic oligonucleotide
aaactgtatgagtgttattagacacgctttgtacctcgagggttgaattctagcgaggac

SEQ ID NO: 676 - DNA, 60 bp, Artificial Sequence
  Description of Artificial Sequence: Synthetic oligonucleotide
aggcaaagacgcacacgatggaccgtaagaccggggacaccgtcgtaaattacaatgttt

SEQ ID NO: 677 - DNA, 60 bp, Artificial Sequence
  Description of Artificial Sequence: Synthetic oligonucleotide
ccaccacaactgctctaacagctcctccacttcctttccgtttcctgatactgactctag

SEQ ID NO: 678 - DNA, 60 bp, Artificial Sequence
  Description of Artificial Sequence: Synthetic oligonucleotide
tctccaagtccagcttcactagcagcttagagcagagacaatggctgcagcaagagtgat

SEQ ID NO: 679 - DNA, 60 bp, Artificial Sequence
  Description of Artificial Sequence: Synthetic oligonucleotide
cacgtggcccgcagctgatatggcacctatgaagcactagtagtagaccagtaacattat

SEQ ID NO: 680 - DNA, 60 bp, Artificial Sequence
  Description of Artificial Sequence: Synthetic oligonucleotide
agattgttgtgggccatttgtcttgtcttgtcttgtcttgatgactttggaccgctcgaa

SEQ ID NO: 681 - DNA, 60 bp, Artificial Sequence
  Description of Artificial Sequence: Synthetic oligonucleotide
agggtctcaattctaagaatctctagaggtcttcgaggtgtgactttttagtaagtactt

SEQ ID NO: 682 - DNA, 60 bp, Artificial Sequence
  Description of Artificial Sequence: Synthetic oligonucleotide
ctctctctcggtctgtgtgaagactgaagttctgctcagtcttttgcaggggaagcaaag

SEQ ID NO: 683 - DNA, 60 bp, Artificial Sequence
  Description of Artificial Sequence: Synthetic oligonucleotide
ggtggagttctaccacccgcaactatgtagcttttcctatcattagtagtctttttgccg

SEQ ID NO: 684 - DNA, 60 bp, Artificial Sequence
  Description of Artificial Sequence: Synthetic oligonucleotide
tgatttgattatcgccgatactaacgtctatatagatgaattgtcatatagatcatgttc

SEQ ID NO: 685 - DNA, 60 bp, Artificial Sequence
  Description of Artificial Sequence: Synthetic oligonucleotide
attgatcgtcagttaatttggctctgtatgttttatgtgacaggcaaaattagaatattg

SEQ ID NO: 686 - DNA, 60 bp, Artificial Sequence
  Description of Artificial Sequence: Synthetic oligonucleotide
ttgccgggtttgaagaccacttaaataacgcgatacttaatcgccgatatggtttgaata

SEQ ID NO: 687 - DNA, 60 bp, Artificial Sequence
  Description of Artificial Sequence: Synthetic oligonucleotide
atgcccgatatgcctatatttttcgatcaagacagccgcaagctaccatggtcgtagatg

SEQ ID NO: 688 - DNA, 60 bp, Artificial Sequence
  Description of Artificial Sequence: Synthetic oligonucleotide
ccaattccgatactaattatcgaacccgtgcttacaaccttttactagcacaagtcgtga

SEQ ID NO: 689 - DNA, 60 bp, Artificial Sequence
  Description of Artificial Sequence: Synthetic oligonucleotide
ctcgatcggtggtaattcgcttcacgaattgtcgatagcttatagtgagaagtaaagatg

SEQ ID NO: 690 - DNA, 60 bp, Artificial Sequence
  Description of Artificial Sequence: Synthetic oligonucleotide
ggcaagcggtatgtccaatacattaaggcttaggccattaagtaatgtgggactataata

SEQ ID NO: 691 - DNA, 9298 bp, Artificial Sequence
  Description of Artificial Sequence: Synthetic plasmid
cgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggtttttcttttcaccagtgagacgggcaacagctgattgcccttcaccgcctggccctgagagagttgcagcaagcggtccacgctggtttgccccagcaggcgaaaatcctgtttgatggtggttccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccacggccgctctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctggagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatttatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaaggatatcctgatccgttgacggcgcgccaagcggccgcggccgggtggtgacatttattcataaattcatctcaaaacaagaaggatttacaaaaataaaagaaaacaaaattttcatctttaacataattataattgtgttcacaaaattcaaacttaaacccttaatataaagaatttctttcaacaatacactttaatcacaacttcttcaatcacaacctcctccaacaaaattaaaatagattaataaataaataaacttaactatttaaaaaaaaatattatacaaaatttattaaaacttcaaaataaacaaactttttatacaaaattcatcaaaactttaaaataaagctaaacactgaaaatgtgagtacatttaaaaggacgctgatcacaaaaattttgaaaacataaacaaacttgaaactctaccttttaagaatgagtttgtcgtctcattaactcattagttttatagttcgaatccaattaacgtatcttttattttatggaataagggtgttttaataagtgattttgggatttttttagtaatttatttgtgatatgttatggagtttttaaaaatatatatatatatatatatttttgggttgagtttacttaaaatttggaaaaggttggtaagaactataaattgagttgtgaatgagtgttttatggattttttaagatgttaaatttatatatgtaattaaaattttattttgaataacaaaaattataattggataaaaaattgttttgttaaatttagagtaaaaatttcaaaatctaaaataattaaacactattatttttaaaaaatttgttggtaaattttatcttatatttaagttaaaatttagaaaaaattaattttaaattaataaacttttgaagtcaaatattccaaatattttccaaaatattaaatctattttgcattcaaaatacaatttaaataataaaacttcatggaatagattaaccaatttgtataaaaaccaaaaatctcaaataaaatttaaattacaaaacattatcaacattatgatttcaagaaagacaataaccagtttccaataaaataaaaaacctcatggcccgtaattaagatctcattaattaattcttattttttaatttttttacatagaaaatatctttatattgtatccaagaaatatagaatgttctcgtccagggactattaatctccaaacaagtttcaaaatcattacattaaagctcatcatgtcatttgtggattggaaattatattgtataagagaaatatagaatgttctcgtctagggactattaatttccaaacaaatttcaaaatcattacattaaagctcatcatgtcatttgtggattggaaattagacaaaaaaaatcccaaatatttctctcaatctcccaaaatatagttcgaactccatatttttggaaattgagaatttttttacccaataatatatttttttatacattttagagattttccagacatatttgctctgggatttattggaatgaaggttgagttataaactttcagtaatccaagtatcttcggtttttgaagatactaaatccattatataataaaaacacattttaaacaccaatttaatgggatttcagatttgtatcccatgctattggctaaggcatttttcttattgtaatctaaccaattctaatttccacctggtgtgaactgactgacaaatgcggtccgaaaacagcgaatgaaatgtctgggtgatcggtcaaacaagcggtgggcgagagagcgcgggtgttggcctagccgggatgggggtaggtagacggcgtattaccggcgagttgtccgaatggagttttcggggtaggtagtaacgtagacgtcaatggaaaaagtcataatctccgtcaaaaatccaaccgctccttcacatcgcagagttggtggccacgggaccctccacccactcactcgatcgcctgccgtggttgcccattattcaaccatacgccacttgactcttcaccaacaattccaggccggctttctatacaatgtactgcacaggaaaatccaatataaaaagccggcctctgcttccttctcagtagcccccagctcattcaattcttcccactgcaggctacatttgtcagacacgttttccgccatttttcgcctgtttctgcggagaatttgatcaggttcggattgggattgaatcaattgaaaggtttttattttcagtatttcgatcgccggatcccccgggctgcaggaattcgtccagcagttgtctggagctccaccagaaatctggaagctctacaattggctagcaaagtacttaaagcttccatcgatgggtgttatttgtggataataaattcgggtgatgttcagtgtttgtcgtatttctcacgaataaattgtgtttatgtatgtgttagtgttgtttgtctgtttcagaccctcttatgttatatttttcttttcgtcggtcagttgaagccaatactggtgtcctggccggcactgcaataccatttcgtttaatataaagactctgttatccgtgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgcggccgcatttaaatgggccctgttaactggtaccttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatc

SEQ ID NO: 692 - DNA, 4724 bp, Artificial Sequence
  Description of Artificial Sequence: Synthetic plasmid
cgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggtttttcttttcaccagtgagacgggcaacagctgattgcccttcaccgcctggccctgagagagttgcagcaagcggtccacgctggtttgccccagcaggcgaaaatcctgtttgatggtggttccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccacggccgctctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtgg

SEQ ID NO: 693 - DNA, 10944 bp, Artificial Sequence
  Description of Artificial Sequence: Synthetic plasmid
cgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggtttttcttttcaccagtgagacgggcaacagctgattgcccttcaccgcctggccctgagagagttgcagcaagcggtccacgctggtttgccccagcaggcgaaaatcctgtttgatggtggttccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccacggccgctctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctggagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatttatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaaggatatcctgatccgttgacggcgcgccaagcggccgcggccgggtggtgacatttattcataaattcatctcaaaacaagaaggatttacaaaaataaaagaaaacaaaattttcatctttaacataattataattgtgttcacaaaattcaaacttaaacccttaatataaagaatttctttcaacaatacactttaatcacaacttcttcaatcacaacctcctccaacaaaattaaaatagattaataaataaataaacttaactatttaaaaaaaaatattatacaaaatttattaaaacttcaaaataaacaaactttttatacaaaattcatcaaaactttaaaataaagctaaacactgaaaatgtgagtacatttaaaaggacgctgatcacaaaaattttgaaaacataaacaaacttgaaactctaccttttaagaatgagtttgtcgtctcattaactcattagttttatagttcgaatccaattaacgtatcttttattttatggaataagggtgttttaataagtgattttgggatttttttagtaatttatttgtgatatgttatggagtttttaaaaatatatatatatatatatatttttgggttgagtttacttaaaatttggaaaaggttggtaagaactataaattgagttgtgaatgagtgttttatggattttttaagatgttaaatttatatatgtaattaaaattttattttgaataacaaaaattataattggataaaaaattgttttgttaaatttagagtaaaaatttcaaaatctaaaataattaaacactattatttttaaaaaatttgttggtaaattttatcttatatttaagttaaaatttagaaaaaattaattttaaattaataaacttttgaagtcaaatattccaaatattttccaaaatattaaatctattttgcattcaaaatacaatttaaataataaaacttcatggaatagattaaccaatttgtataaaaaccaaaaatctcaaataaaatttaaattacaaaacattatcaacattatgatttcaagaaagacaataaccagtttccaataaaataaaaaacctcatggcccgtaattaagatctcattaattaattcttattttttaatttttttacatagaaaatatctttatattgtatccaagaaatatagaatgttctcgtccagggactattaatctccaaacaagtttcaaaatcattacattaaagctcatcatgtcatttgtggattggaaattatattgtataagagaaatatagaatgttctcgtctagggactattaatttccaaacaaatttcaaaatcattacattaaagctcatcatgtcatttgtggattggaaattagacaaaaaaaatcccaaatatttctctcaatctcccaaaatatagttcgaactccatatttttggaaattgagaatttttttacccaataatatatttttttatacattttagagattttccagacatatttgctctgggatttattggaatgaaggttgagttataaactttcagtaatccaagtatcttcggtttttgaagatactaaatccattatataataaaaacacattttaaacaccaatttaatgggatttcagatttgtatcccatgctattggctaaggcatttttcttattgtaatctaaccaattctaatttccacctggtgtgaactgactgacaaatgcggtccgaaaacagcgaatgaaatgtctgggtgatcggtcaaacaagcggtgggcgagagagcgcgggtgttggcctagccgggatgggggtaggtagacggcgtattaccggcgagttgtccgaatggagttttcggggtaggtagtaacgtagacgtcaatggaaaaagtcataatctccgtcaaaaatccaaccgctccttcacatcgcagagttggtggccacgggaccctccacccactcactcgatcgcctgccgtggttgcccattattcaaccatacgccacttgactcttcaccaacaattccaggccggctttctatacaatgtactgcacaggaaaatccaatataaaaagccggcctctgcttccttctcagtagcccccagctcattcaattcttcccactgcaggctacatttgtcagacacgttttccgccatttttcgcctgtttctgcggagaatttgatcaggttcggattgggattgaatcaattgaaaggtttttattttcagtatttcgatcgccggatcccccgggctgcaggaattcgtccagcagttgtctggagctccaccagaaatctggaagctctacaattggctagtggatccaaagaattcggcacgaggccgtatcattatttcagtcattatcgataatgataagcctcaaatatgaatcaatagtctcttagtcatttaatttatggttttcagtgtcgatgtgctctcctgccagggctccaccaatctcctttaggttcagtgtacatcgtctgaaaataagttgacaaggccaggtcaatgcagaagcctcctggcttggggaccctaagtgtgaaatcaatatattttcctcgagttcttgacctgttagcaacttcgacactgcaacttgtcctaatctttgctgtgtattatgtattttgttccaagtattggagtgtagcacagtggatggtagagaggaggatctagatcagtcacttttacatagaatggagatgatagtaaaagcaactacaattacgatcttgctaccagtcatcctatgttgcatcccatgtggagaaagtggaagcggaggcaggagtttggcgcagcgtttaccagccctaggcgttgactatggacaaactgcagacaatcttcctccaccatctgcagtagcaaagctggttcagagtacaagtatttcaaagttgagactatatggagcagatcctgcaattcttcaagcatttgctaacacaggaattgggttagttgtaggcattggtaacgatcaaatcccatctctgaaccagctggctgttgcacagaattggattaagaacaatatcgttccttttgttcctgccactgatatcattggaatctcggtggggaacgaggttctgttcagtggggatgggagtctgatttcccagctcctccctgcattgcagaacctacacactgcccttgttgaggtttcacttgaccagcaaattaaggtctccacacctcattctctggccatactttctacatctgtccccccatctgctggccgtttcaatgaaagttttgacatgaaatccctgcttgacttcttgcagaagataggggccccattaatgatcaacccatacccctactttgcttacaagagtaatcccaccgatcaaaccctggcttatgcactcttcgagcccaacccgggcttctatgacacaaacagtgggctcacctataccaacatgtttgatgctcagcttgatgcagtgtactcagccatgaaatatctgggttaccctggtgttgatatagtggtggctgaaacaggatggccagctgtgggggatcctacagagacaggggtgagcttacagaatgcaattgcttacaatggcaacctgatcaagcatgtgacgtccatgacggggaccccattgaggccaaataggtacattcaaacctatatttttgccctctttaatgaggatctgaagccaggaccaacttcggagcgcaattatgggctgtttaaagttgatatgacaatggcttatgatgtgggtttgttgcaatcgccgagtgcagctccatctcctcctgctccacgcactggggggcctgtgacaactcctcctacaggtaaagtttggtgcattgccaagccgggcgccgaagagcaaactttggaggcaaatttgaactatgtttgtggacagggcattgactgtaggcctattcaaccaggaggtccttgctattcaccaaatacagtggcaggccatgctgcttatgccatgaacgcatactatcagactgcgggtcggaacaattggaattgtgattttgcgcagacgggaactcttacctccacagatccaagctacggggcctgcgtgtacccgaccgtctaagatatgaatcaatcaatcaatcctagtgttttctattccacttgttgttcggtatatattttccaacttgtcttttcatatgagtgagatgtatgaggtacctattttcaaagttgtgatagcatatacatcataagatgtaatgtgtatgtttgggttttaaaaaaaaaaaaaaactcgagagtacttaaagcttgcactaccatgctataacagatactacttatgtatttcttatgctttgtgtgattttgtctctgtcttgtcctcgttaaatttgcttgcatgttgcctttaagcattgttagctaaattatgttgtttctgtgagttcaaatctttgaacaaaatttagggcttacaaaccatgcggccgcggtaccttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatc

SEQ ID NO: 694 - DNA, 10971 bp, Artificial Sequence
  Description of Artificial Sequence: Synthetic plasmid
cgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggtttttcttttcaccagtgagacgggcaacagctgattgcccttcaccgcctggccctgagagagttgcagcaagcggtccacgctggtttgccccagcaggcgaaaatcctgtttgatggtggttccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccacggccgctctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctggagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatttatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaaggatatcctgatccgttgacggcgcgccaagcggccgcggccgggtggtgacatttattcataaattcatctcaaaacaagaaggatttacaaaaataaaagaaaacaaaattttcatctttaacataattataattgtgttcacaaaattcaaacttaaacccttaatataaagaatttctttcaacaatacactttaatcacaacttcttcaatcacaacctcctccaacaaaattaaaatagattaataaataaataaacttaactatttaaaaaaaaatattatacaaaatttattaaaacttcaaaataaacaaactttttatacaaaattcatcaaaactttaaaataaagctaaacactgaaaatgtgagtacatttaaaaggacgctgatcacaaaaattttgaaaacataaacaaacttgaaactctaccttttaagaatgagtttgtcgtctcattaactcattagttttatagttcgaatccaattaacgtatcttttattttatggaataagggtgttttaataagtgattttgggatttttttagtaatttatttgtgatatgttatggagtttttaaaaatatatatatatatatatatttttgggttgagtttacttaaaatttggaaaaggttggtaagaactataaattgagttgtgaatgagtgttttatggattttttaagatgttaaatttatatatgtaattaaaattttattttgaataacaaaaattataattggataaaaaattgttttgttaaatttagagtaaaaatttcaaaatctaaaataattaaacactattatttttaaaaaatttgttggtaaattttatcttatatttaagttaaaatttagaaaaaattaattttaaattaataaacttttgaagtcaaatattccaaatattttccaaaatattaaatctattttgcattcaaaatacaatttaaataataaaacttcatggaatagattaaccaatttgtataaaaaccaaaaatctcaaataaaatttaaattacaaaacattatcaacattatgatttcaagaaagacaataaccagtttccaataaaataaaaaacctcatggcccgtaattaagatctcattaattaattcttattttttaatttttttacatagaaaatatctttatattgtatccaagaaatatagaatgttctcgtccagggactattaatctccaaacaagtttcaaaatcattacattaaagctcatcatgtcatttgtggattggaaattatattgtataagagaaatatagaatgttctcgtctagggactattaatttccaaacaaatttcaaaatcattacattaaagctcatcatgtcatttgtggattggaaattagacaaaaaaaatcccaaatatttctctcaatctcccaaaatatagttcgaactccatatttttggaaattgagaatttttttacccaataatatatttttttatacattttagagattttccagacatatttgctctgggatttattggaatgaaggttgagttataaactttcagtaatccaagtatcttcggtttttgaagatactaaatccattatataataaaaacacattttaaacaccaatttaatgggatttcagatttgtatcccatgctattggctaaggcatttttcttattgtaatctaaccaattctaatttccacctggtgtgaactgactgacaaatgcggtccgaaaacagcgaatgaaatgtctgggtgatcggtcaaacaagcggtgggcgagagagcgcgggtgttggcctagccgggatgggggtaggtagacggcgtattaccggcgagttgtccgaatggagttttcggggtaggtagtaacgtagacgtcaatggaaaaagtcataatctccgtcaaaaatccaaccgctccttcacatcgcagagttggtggccacgggaccctccacccactcactcgatcgcctgccgtggttgcccattattcaaccatacgccacttgactcttcaccaacaattccaggccggctttctatacaatgtactgcacaggaaaatccaatataaaaagccggcctctgcttccttctcagtagcccccagctcattcaattcttcccactgcaggctacatttgtcagacacgttttccgccatttttcgcctgtttctgcggagaatttgatcaggttcggattgggattgaatcaattgaaaggtttttattttcagtatttcgatcgccggatcccccgggctgcaggaattcggtacccccatggatccagtagaaaccccaacccgtgaaatcaaaaaactcgacggcctgtgggcattcagtctggatcgcgaaaactgtggaattggtcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcaggtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgaatcaacaactctcctggcgcaccatcgtcggctacagcctcgggaattgctaccgagggttcgaaatcgataagcttgcactaccatgctataacagatactacttatgtatttcttatgctttgtgtgattttgtctctgtcttgtcctcgttaaatttgcttgcatgttgcctttaagcattgttagctaaattatgttgtttctgtgagttcaaatctttgaacaaaatttagggcttacaaaccatgcggccgcggtaccttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatc

SEQ ID NO: 695 - DNA, 39 bp, Artificial Sequence
  Description of Artificial Sequence: Synthetic oligonucleotide
agctctacaattggctagcaaagtacttaaagcttccat

SEQ ID NO: 696 - DNA, 37 bp, Artificial Sequence
  Description of Artificial Sequence: Synthetic oligonucleotide
gatgttaaccgatcgtttcatgaatttcgaaggtagc

What is claimed is:

1. An isolated polynucleotide comprising a nucleic acid sequence at least 95% identical to SEQ ID NO: 93.

2. The isolated polynucleotide of claim 1, wherein the polynucleotide is greater than or equal to 99%, 98%, 97%, 96%, or 95%, identical to SEQ ID NO: 93.

3. A DNA construct comprising the polynucleotide of claim 1.

4. The DNA construct of claim 3, further comprising a promoter, wherein the promoter and the polynucleotide are operably linked.

5. The DNA construct of claim 3, wherein the polynucleotide encodes an RNA transcript.

6. The DNA construct of claim 5, wherein the polynucleotide is in a sense or antisense orientation relative to the promoter.

7. The DNA construct of claim 5, wherein the RNA transcript induces RNA interference of a polynucleotide having the nucleic acid sequence of SEQ ID NO: 93.

8. A plant cell transformed with the DNA construct of claim 3.

9. A transgenic plant comprising the plant cell of claim 8.

10. The transgenic plant of claim 9, wherein a phenotype of the plant is different from a phenotype of a plant of the same species that has not been transformed with the DNA construct.

11. The transgenic plant of claim 9, wherein the plant is a woody plant.

12. The transgenic plant of claim 11, wherein the plant is a tree.

13. Wood obtained from a transgenic tree which has been transformed with the DNA construct of claim 3.

14. Wood pulp obtained from a transgenic tree, wherein the wood pulp comprises the DNA construct of claim 3.

15. The DNA construct of claim 5, wherein the RNA transcript is a small interfering RNA.

16. A DNA construct, comprising a polynucleotide that encodes an RNA transcript, wherein the RNA transcript induces RNA interference of a polynucleotide having the nucleic acid sequence of SEQ ID NO: 93.

* * * * *